United States Patent
McNeel et al.

(10) Patent No.: US 10,191,056 B2
(45) Date of Patent: *Jan. 29, 2019

(54) DIAGNOSTIC EVALUATION OF ANTIBODY RESPONSES TO COMMONLY RECOGNIZED PROSTATE CANCER-ASSOCIATED ANTIGENS

(71) Applicant: Wisconsin Alumni Research Foundation, Madison, WI (US)

(72) Inventors: Douglas G. McNeel, Madison, WI (US); Brett B. Maricque, Green Bay, WI (US)

(73) Assignee: Wisconsin Alumni Research Foundation, Madison, WI (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/757,607

(22) Filed: Dec. 23, 2015

(65) Prior Publication Data
US 2016/0238606 A1    Aug. 18, 2016

Related U.S. Application Data

(63) Continuation of application No. 13/088,594, filed on Apr. 18, 2011.

(60) Provisional application No. 61/324,953, filed on Apr. 16, 2010.

(51) Int. Cl.
| | | |
|---|---|---|
| *C40B 40/10* | (2006.01) | |
| *G01N 33/574* | (2006.01) | |
| *G01N 33/531* | (2006.01) | |

(52) U.S. Cl.
CPC ....... *G01N 33/57434* (2013.01); *C40B 40/10* (2013.01); *G01N 33/531* (2013.01); *G01N 2800/60* (2013.01)

(58) Field of Classification Search
None
See application file for complete search history.

(56) References Cited

U.S. PATENT DOCUMENTS

| | | | | |
|---|---|---|---|---|
| 4,208,479 A | * | 6/1980 | Zuk | C07J 41/0016 435/7.72 |
| 7,635,753 B2 | * | 12/2009 | McNeel | G01N 33/5743 530/350 |
| 2008/0206289 A1 | * | 8/2008 | McNeel | G01N 33/5743 424/277.1 |

FOREIGN PATENT DOCUMENTS

| | | |
|---|---|---|
| WO | WO2000000824 | 1/2000 |
| WO | WO2008103645 A2 | 8/2008 |
| WO | WO2011130742 A3 | 12/2011 |

OTHER PUBLICATIONS

Maricque et al. (The Prostate Jul. 14, 2010, 71: 134-146).*
Macmillan Dictionary (Kit, http://www.macmillandictionary.com/dictionary/american/kit, retrieved Aug. 23, 2013).*
Morse and McNeel (Human Immunology, Mar. 5, 2010, 71:496-504).*
Benjamini et al. "Controlling the False Discovery Rate: A Practical and Powerful Approach to Multiple Testing" J. Roy. Stat. Soc. B vol. 57, 1995, pp. 289-300.
Bradford, T. et al., "Cancer immunomics: using autoantibody signatures in the early detection of prostate cancer," Urol. Oncol. 24:237-242 (2006).
Brinkmann, U., et al., "Novel genes in the PAGE and GAGE family of tumor antigens found by homology walking in the dbEST database," Cancer Res. 59:1445-1448 (1999).
Chen, M., et al., Isolation and characterization of PAGE-1 and GAGE-7. New genes expressed in the LNCaP prostate cancer progression model that share homology with melanoma-associated antigens, J. Biol. Chem. 273:17618-17625 (1998).
Chen, Y., et al., "A testicular antigen aberrantly expressed in human cancers detected by autologous antibody screening," Proc. Natl. Acad. Sci. USA 94:1914-1918 (1997).
Chen, Y., et al., "Identification of multiple cancer/testis antigens by allogeneic antibody screening of a melanoma cell line library," Proc Natl Acad Sci USA 95:6919-6923 (1998).
Crew, A., et al., "Fusion of SYT to two genes, SSX1 and SSX2, encoding proteins with homology to the Kruppel-associated box in human synovial sarcoma," Embo. J. 14:2333-2340 (1995).
De Marzo, A.M. et al., "Proliferative Inflammatory Atrophy of the Prostate : Implications for Prostatic Carcinogenesis", Am. J. Pathol. vol. 155, No. 6, 1999, pp. 1985-1992.
De Plaen, E., et al., "Structure, chromosomal localization, and expression of 12 genes of the MAGE family," Immunogenetics 40:360-369 (1994).
Dennis, L.K. et al, "Epidemiologic association between prostatitis and prostate cancer", Urology vol. 60,No. 1, 2002, pp. 78-83.
Dong, X., et al., "Identification of two novel CT antigens and their capacity to elicit antibody response in hepatocellular carcinoma patients," Br. J. Cancer 89:291-297 (2003).
Dubovsky, J.A. & D.G. McNeel, "Inducible expression of a prostate cancer-testis antigen, SSX-2, following treatment with a DNA methylation inhibitor", Prostate vol. 67, No. 16,, 2007, pp. 1781-1790.
Dubovsky, J.A. et al., "MAD-CT-2 Identified as a Novel Melanoma Cancer-testis Antigen Using Phage Immunoblot Analysis", J. Immunother. vol. 30,No. 7, 2007, pp. 675-683.
Zendman, A., et al., "CTp11, a novel member of the family of human cancer/testis antigens," Cancer Res. 59:6223-6229 (1999).
Dunphy et al., "Antigen-Specific IgG Elicited in Subjects with Prostate Cancer Treated with Flt3 Ligand" J. Immunother vol. 28, No. 3, 2005, pp. 268-275.
Dunphy, E. J. et al., "Identification of Antigen-Specific IgG in Sera from Patients with Chronic Prostatitis", Journal of Clinical Immunology, vol. 24, No. 5, pp. 492-502 (2004).

(Continued)

*Primary Examiner* — Peter J Reddig
(74) *Attorney, Agent, or Firm* — Quarles & Brady LLP

(57) ABSTRACT

The present invention relates to a plurality of antigens that together form a panel of immunoreactive molecules suitable for identifying candidates for prostate cancer examination. Methods for identifying antibodies indicative of a premalignant or malignant prostate are disclosed. Further disclosed are kits that can be used to practice the above methods.

6 Claims, 17 Drawing Sheets

Specification includes a Sequence Listing.

(56) References Cited

OTHER PUBLICATIONS

Dunphy, E.J. et al., "New approaches to identification of antigenic candidats for future prostate cancer immunotherapy", Update on Cancer Therapeutics, vol. I, pp. 273-284, 2006.

Fossa et al., "Identification of nucleolar protein No55 as a tumour-associated autoantigen in patients with prostate cancer" Br. J. Cancer vol. 83,No. 6, 2000, pp. 743-749.

Gilardoni et al. "Prostate cancer induction in autoimmune rats and modulation of T cell apoptosis" J. Exp. Clin. Cancer Res. vol. 18, 1999, pp. 493-504.

Greene et al., "Prostate Specific Antigen Best Practice Statement: 2009 Update", J Urol vol. 182, issue 5, 2009, pp. 2232-2241.

Gure, A., et al., "SSX: a multigene family with several members transcribed in normal testis and human cancer," Int. J. Cancer 72:965-971 (1997).

Hoeppner, L.H. et al., "Humoral immune responses to testis antigens in sera from patients with prostate cancer", Cancer Immunity, vol. 6, No. 1, pp. 1-11, 2006.

Jemal, A. et al., "Cancer Statistics, 2009", CA Cancer J. Clin. vol. 59, issue 4, pp. 225-249, 2009.

Kasahara, M., et al., "A testis-specific gene Tpx-1 maps between Pgk-2 and Mep-1 on mouse chromosome 17," Immunogenetics 29:61-63 (1989).

Kindt et al.: 'Kuby Immunology', 2006 p. 574.

Lee, S., et al., "Immunomic analysis of human sarcoma," Proc Natl Acad Sci USA 100:2651-2656 (2003).

Lim, S., et al., "Sperm protein 17 is a novel cancer-testis antigen in multiple myeloma," Blood 97:1508-1510 (2001).

Loriot, A., et al., "Five new human cancer-germline genes identified among 12 genes expressed in spermatogonia," Int J. Cancer 105:371-376 (2003).

Lurquin, C., et al., "Two members of the human MAGEB gene family located in Xp21.3 are expressed in tumors of various histological origins," Genomics 46:397-408 (1997).

Maricque, B.B., et al., "Antibody response to prostate-associated antigens in patients with prostatis and prostate cáncer", The Prostate, vol. 71, pp. 134-146, 2011.

McDowell, K.A. et al."Leukocytic promotion of prostate cellular proliferation", Prostate vol. 70,No. 4, 2010, pp. 377-389.

McNeel, D., et al., "Antibody immunity to prostate cancer associated antigens can be detected in the serum of patients with prostate cancer," J. Urol. 164:1825-1829 (2000).

Mercader et al.,"T cell infiltration of the prostate induced by androgen withdrawal in patients with prostate cancer", Proc. Nat. Acad. Sci. vol. 98, No. 25, 2001, pp. 14565-14570.

Mooney, C., et al., "Identification of autoantibodies elicited in a patient with prostate cancer presenting as dermatomyositis," Inter. J. Urology 13:211-217 (2006).

Morse et al., "Prostate cancer patients on androgen deprivation therapy develop persistent changes in adaptive immune responses" Hum. Immunol. 71:496-504 (2010).

Narayanan et al., "Inflammatory processes of prostate tissue microenvironment drive rat prostate carcinogenesis: Preventive effects of celecoxib", Prostate vol. 69, No. 2, 2009, pp. 133-141.

Olson,B.M. and D.G. McNeel, "Antibody and T-cell responses specific for the androgen receptor in patients with prostate cancer", Prostate vol. 67, No. 16, 2007, pp. 1729-1739.

Palapattu et al., "Prostate carcinogenesis and inflammation: emerging insights", Carcinogenesis vol. 26,No. 7, 2005, pp. 1170-1181.

Sahin et al., "Human neoplasms elicit multiple specific immune responses in the autologous host" Proc. Nat. Acad. Sci. vol. 92,No. 25, 1995, pp. 11810-11813.

Sasaki, M., et al., "MAGE-E1, a new member of the melanoma-associated antigen gene family and its expression in human glioma," Cancer Res. 61:4809-4814 (2001).

Scanlan, M., et al., "Identification of cancer/testis genes by database mining and mRNA expression analysis," Int. J. Cancer 98:485-492 (2002).

Scanlan, M.J. et al., "The Cancer/Testis Genes: Review, Standarization, and Commentary", Cancer Immunity, vol. 1, No. 1, pp. 1-15, 2004.

Sfanos, K.S. et al.,"Human prostate-infiltrating CD8+ T lymphocytes are oligoclonal and PD-1+", Prostate vol. 69, No. 15, 2009, pp. 1694-1703.

Smith, H.E, et al., "IgG response to tissue -associated antigens as biomarkers of immunological treatment efficacy", Journal of Biomedicine and Biotechnology, vol. 2011, pp. 1-10.

Thompson, I.M., et al., "The influence of finasteride on the development of prostate cancer", New Eng. Journal of Medicine, vol. 349, No. 3, pp. 215-224, 2003.

Van Den Eynde, B., et al., "A new family of genes coding for an antigen recognized by autologous cytolytic T lymphocytes on a human melanoma," J. Exp. Med. 182:689-698 (1995).

Van Der Bruggen, P., et al., "A gene encoding an antigen recognized by cytolytic T lymphocytes on a human melanoma," Science 254:1643-1647 (1991).

Wang, X., et al., "Autoantibody signatures in prostate cancer," N. Engl. J. Med. 353:1224-1235 (2005).

Yuan, L., et al., "Isolation of a novel gene, TSP50, by a hypomethylated DNA fragment in human breast cancer," Cancer Res. 59:3215-3221 (1999).

* cited by examiner

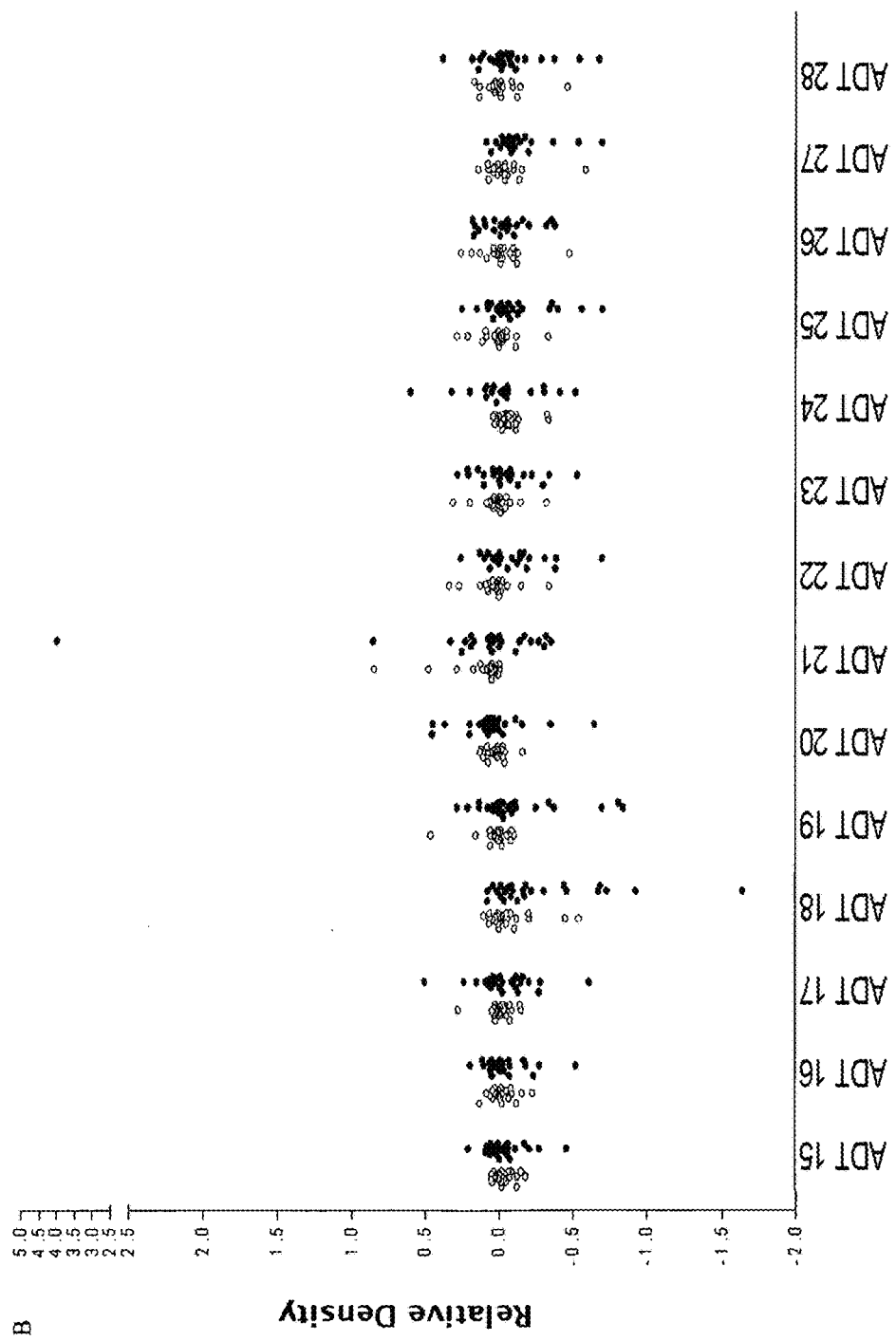
FIGS. 2A-2H, CONT'D.

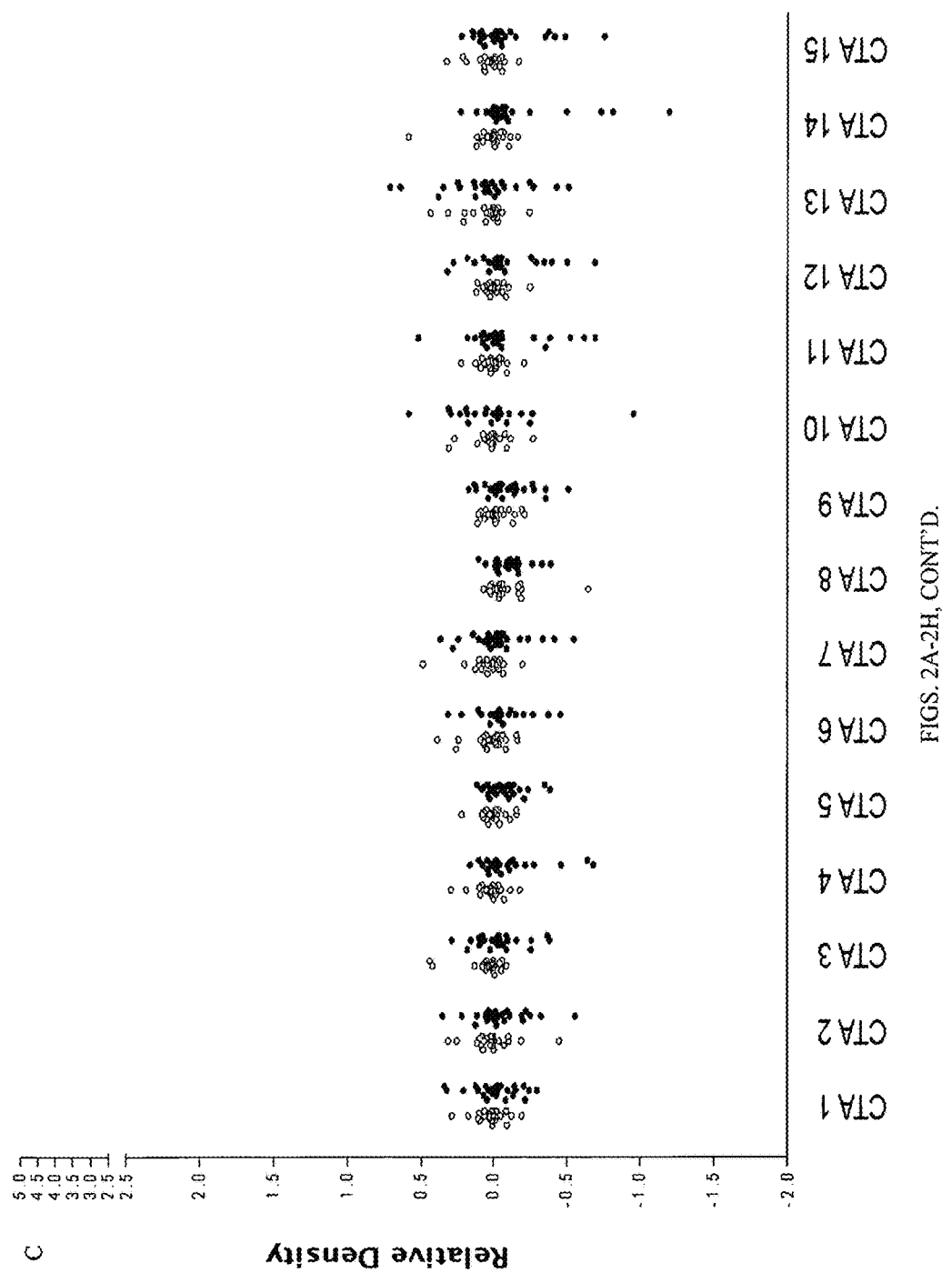
FIGS. 2A-2H, CONT'D.

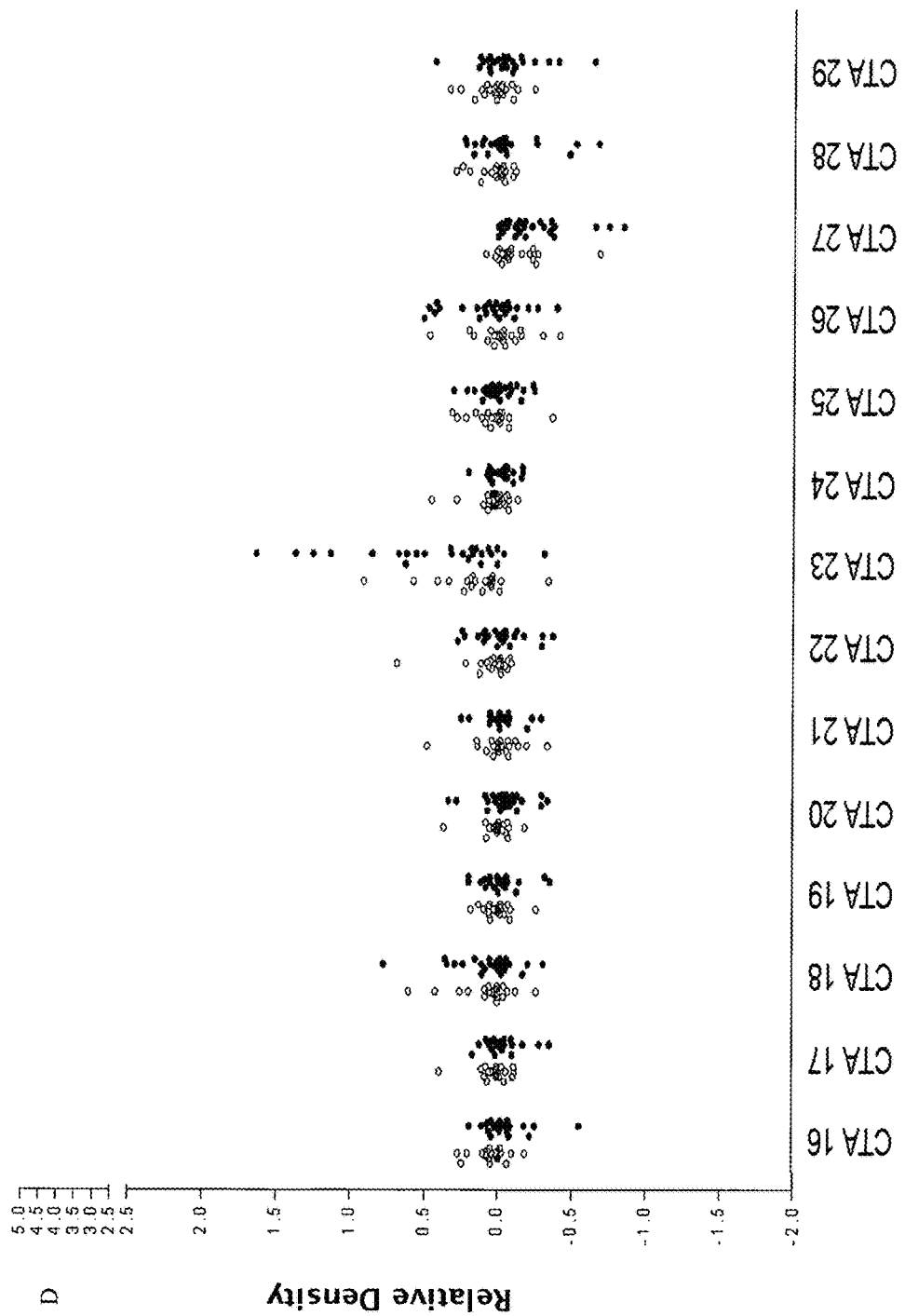
FIGS. 2A-2H, CONT'D.

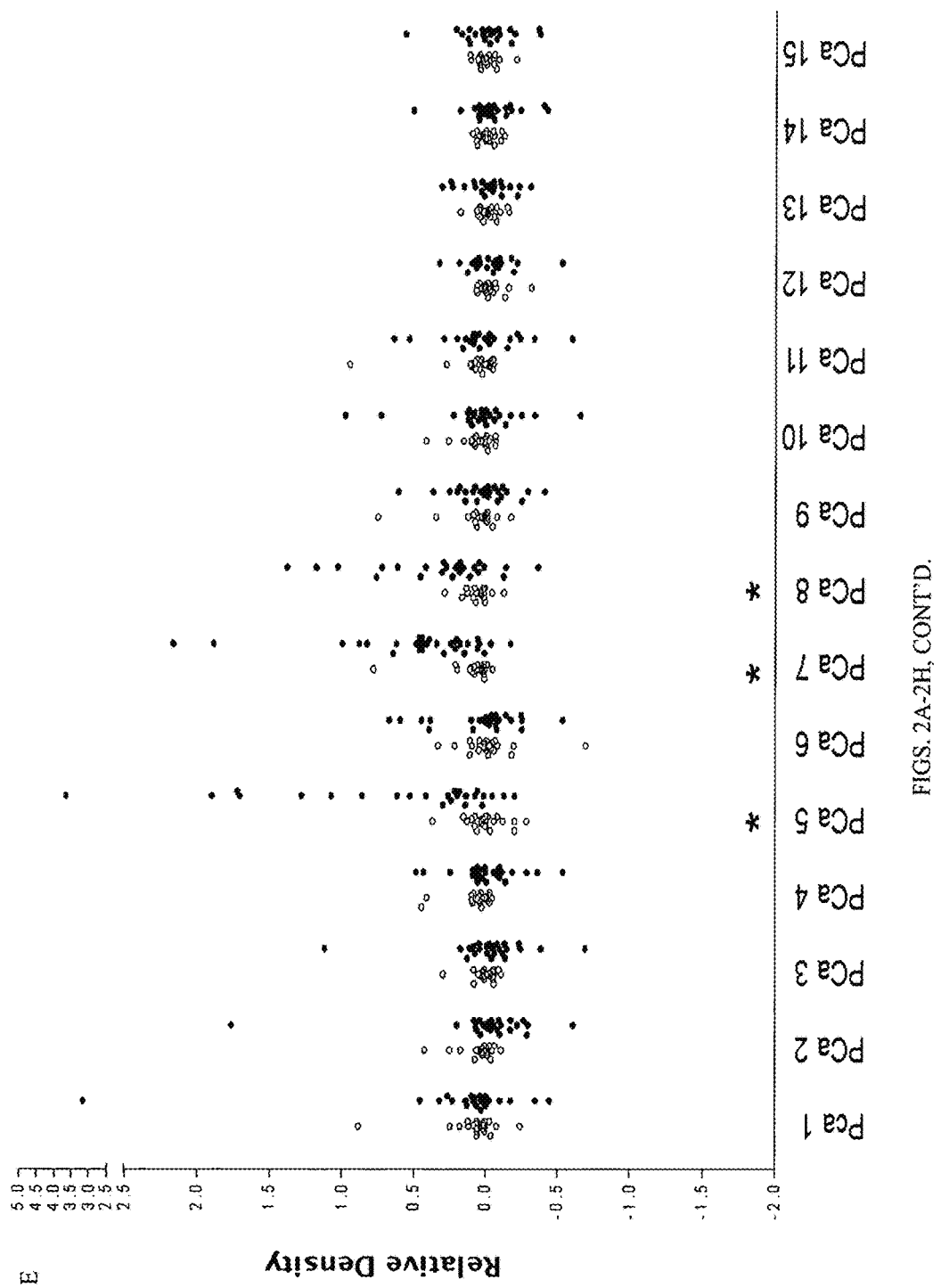
FIGS. 2A-2H, CONT'D.

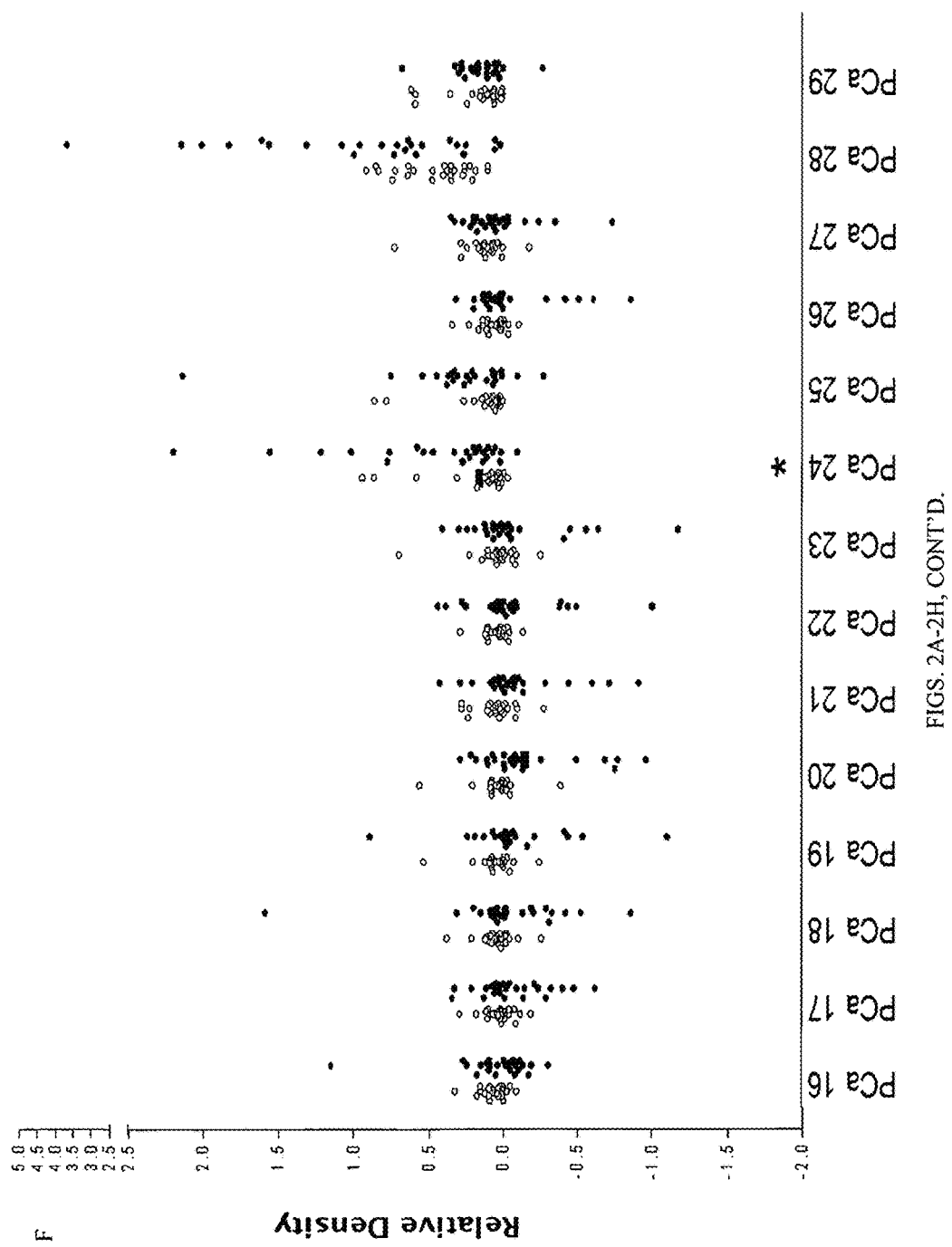
FIGS. 2A-2H, CONT'D.

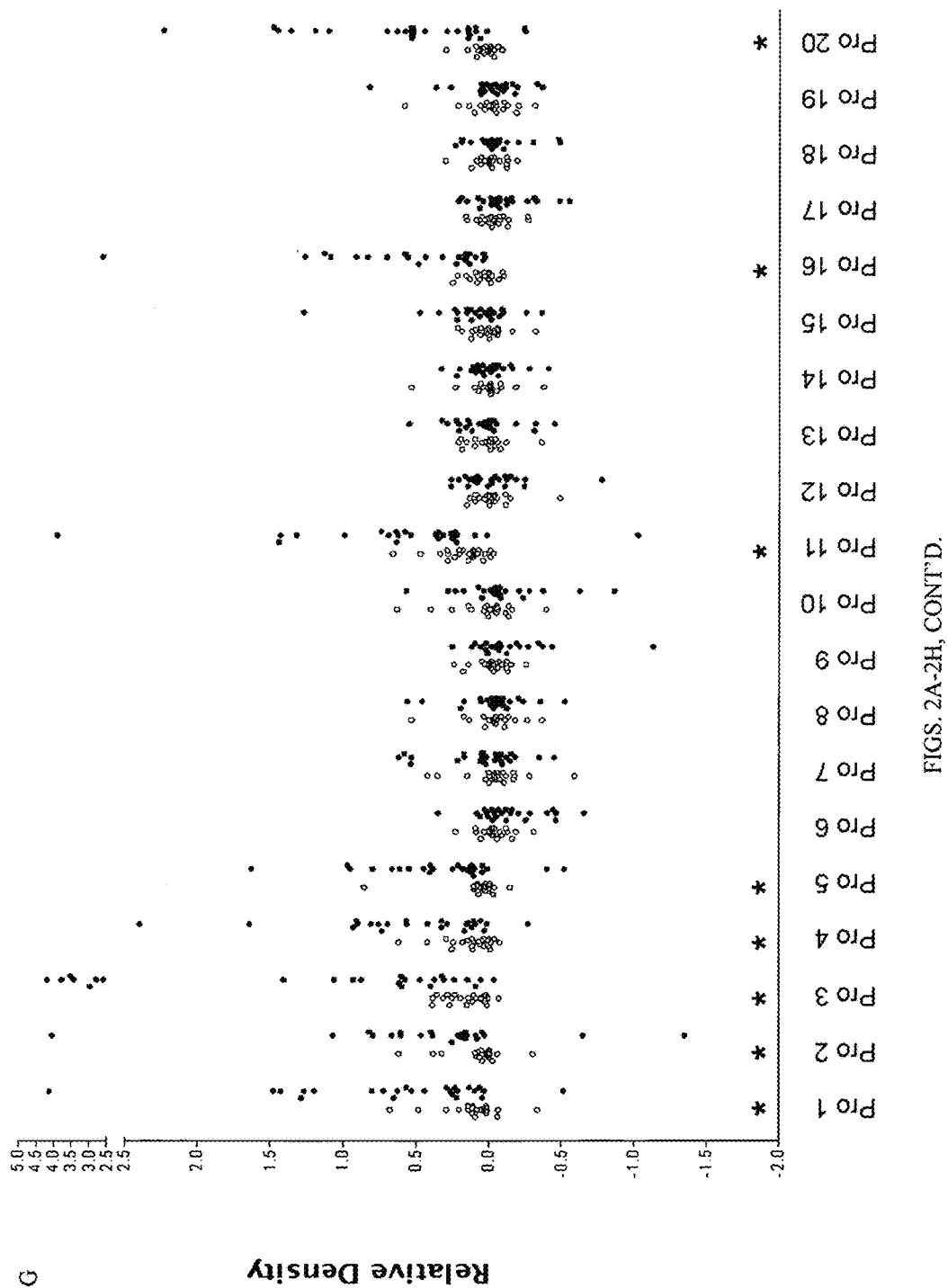
FIGS. 2A-2H, CONT'D.

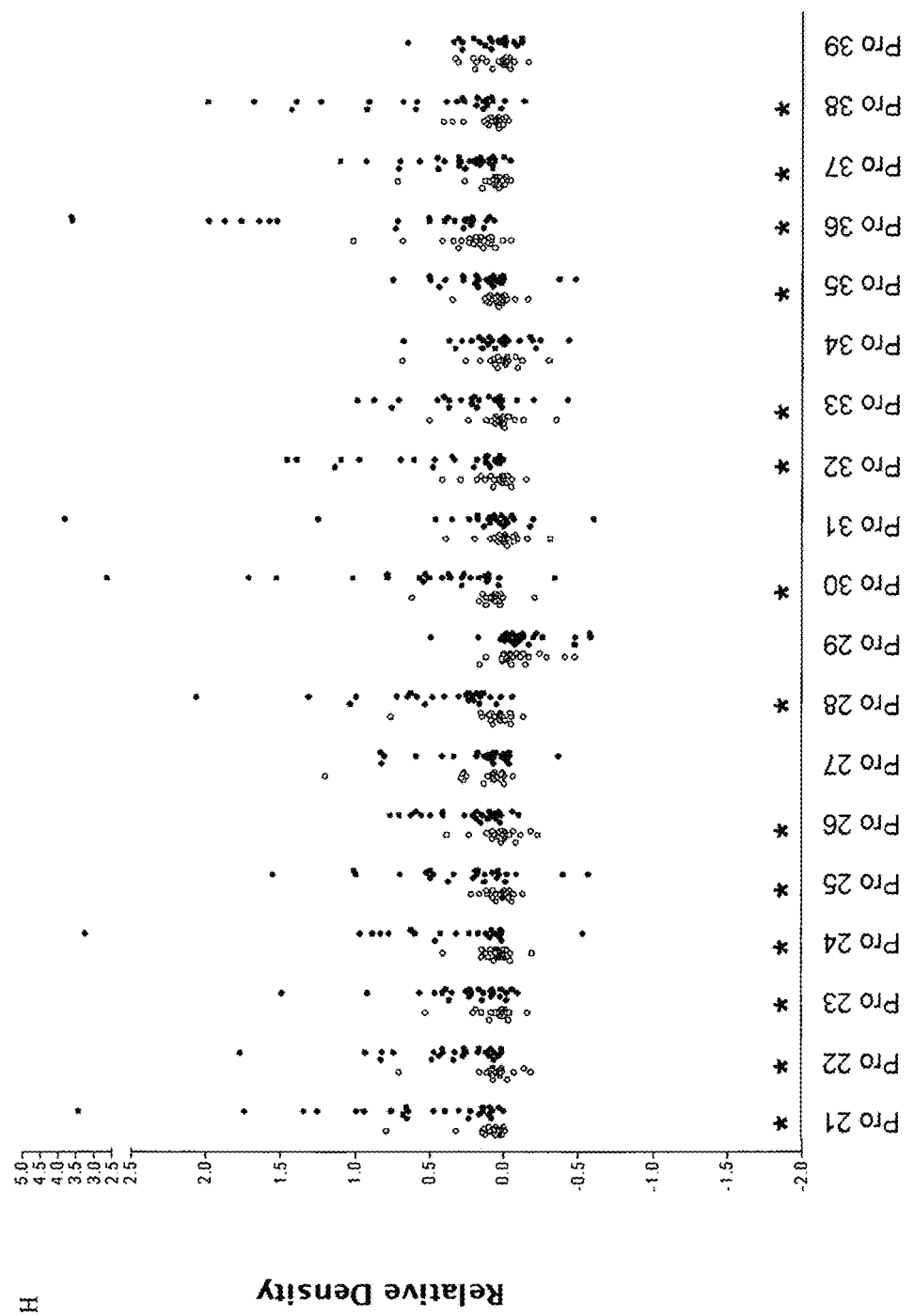
FIGS. 2A-2H, CONT'D.

FIGS. 3A-3F, CONT'D.

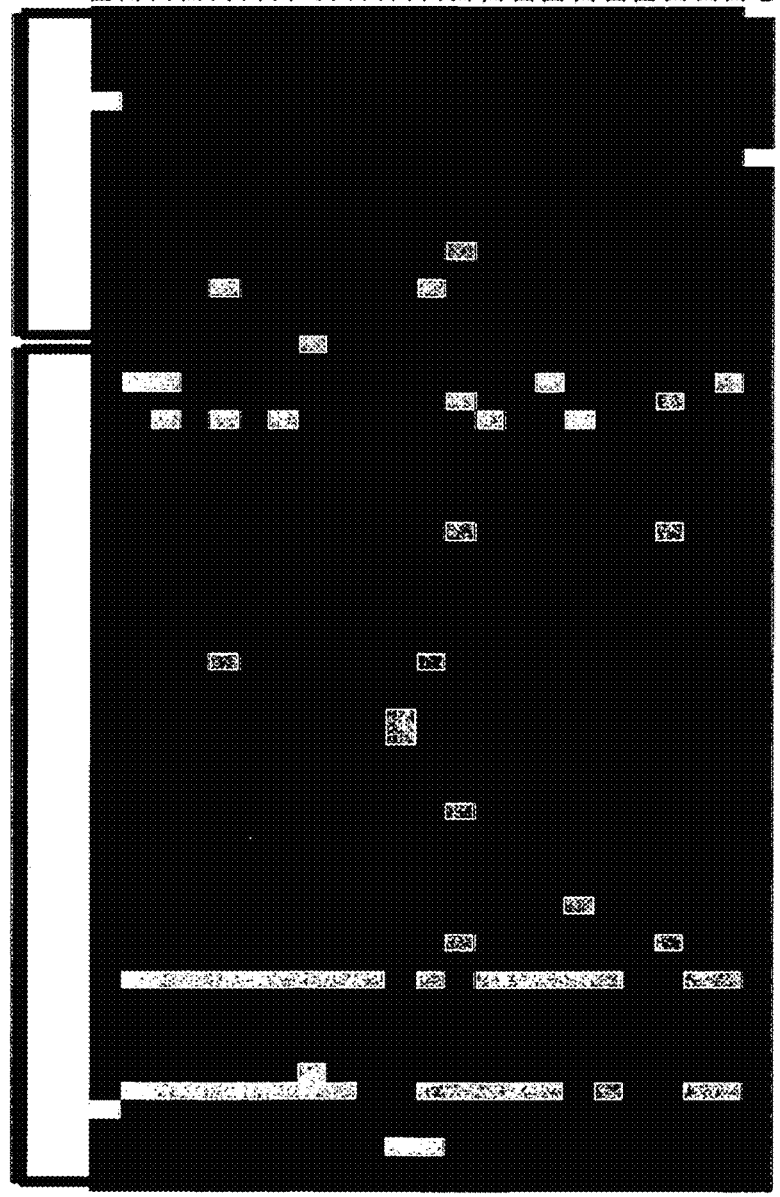
FIGS. 3A-3F, CONT'D.

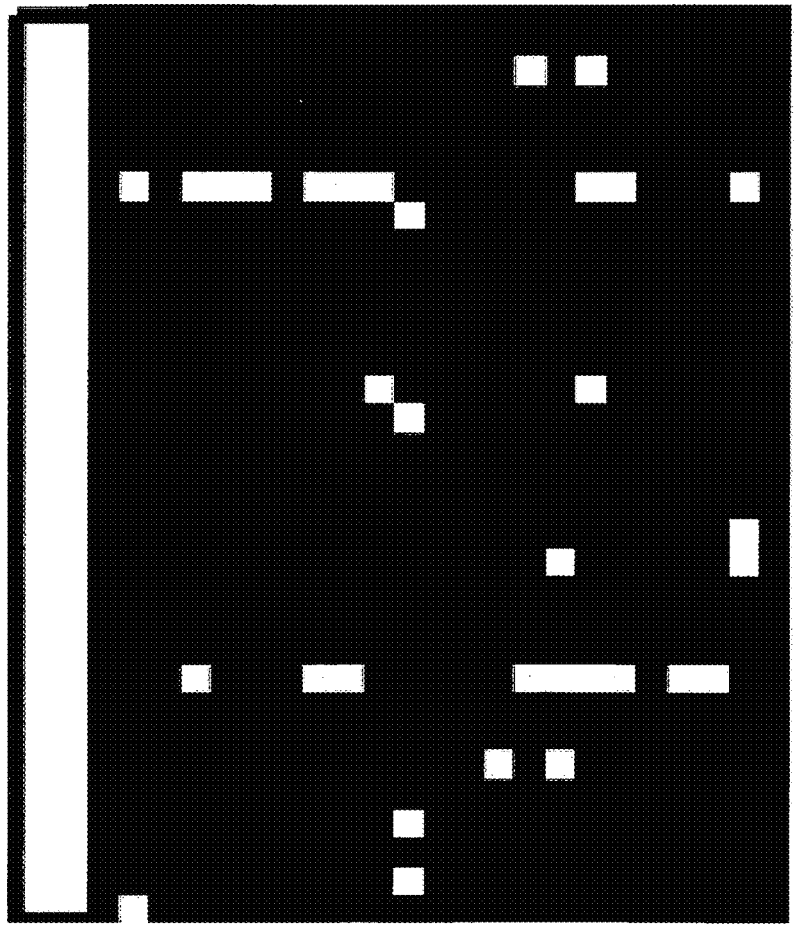
FIGS. 3A-3F, CONT'D.

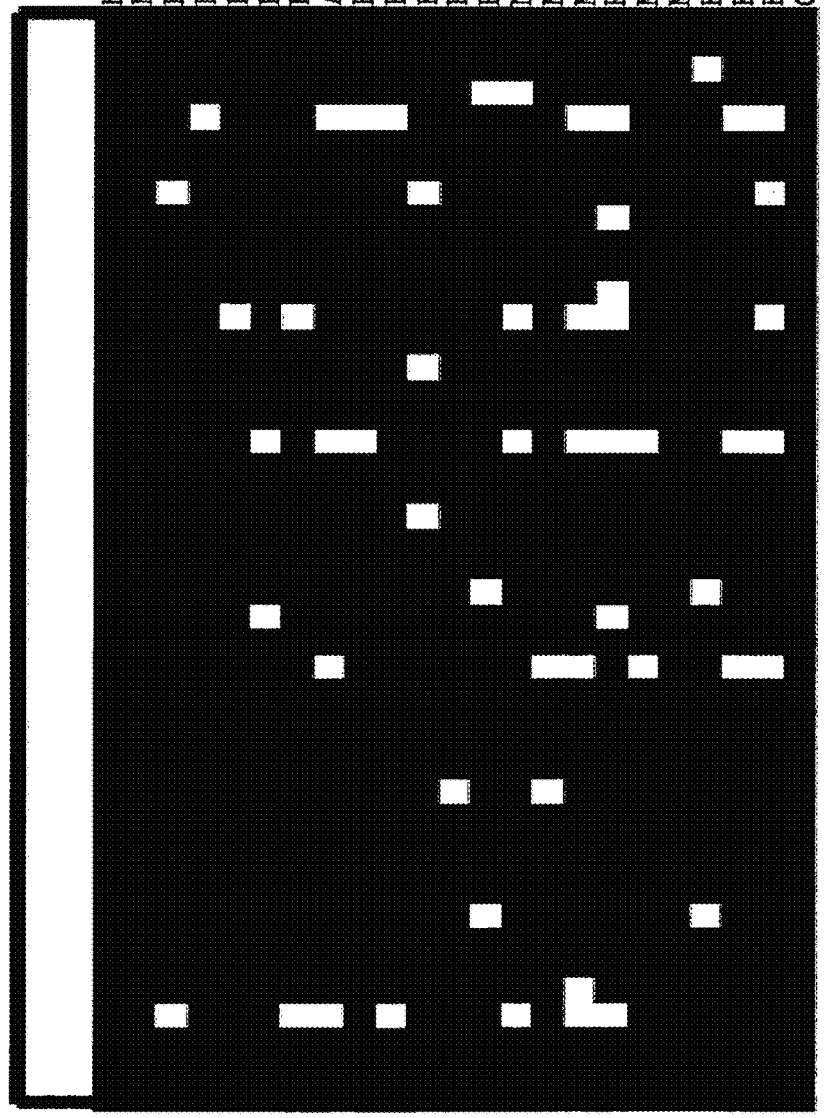
FIGS. 3A-3F, CONT'D.

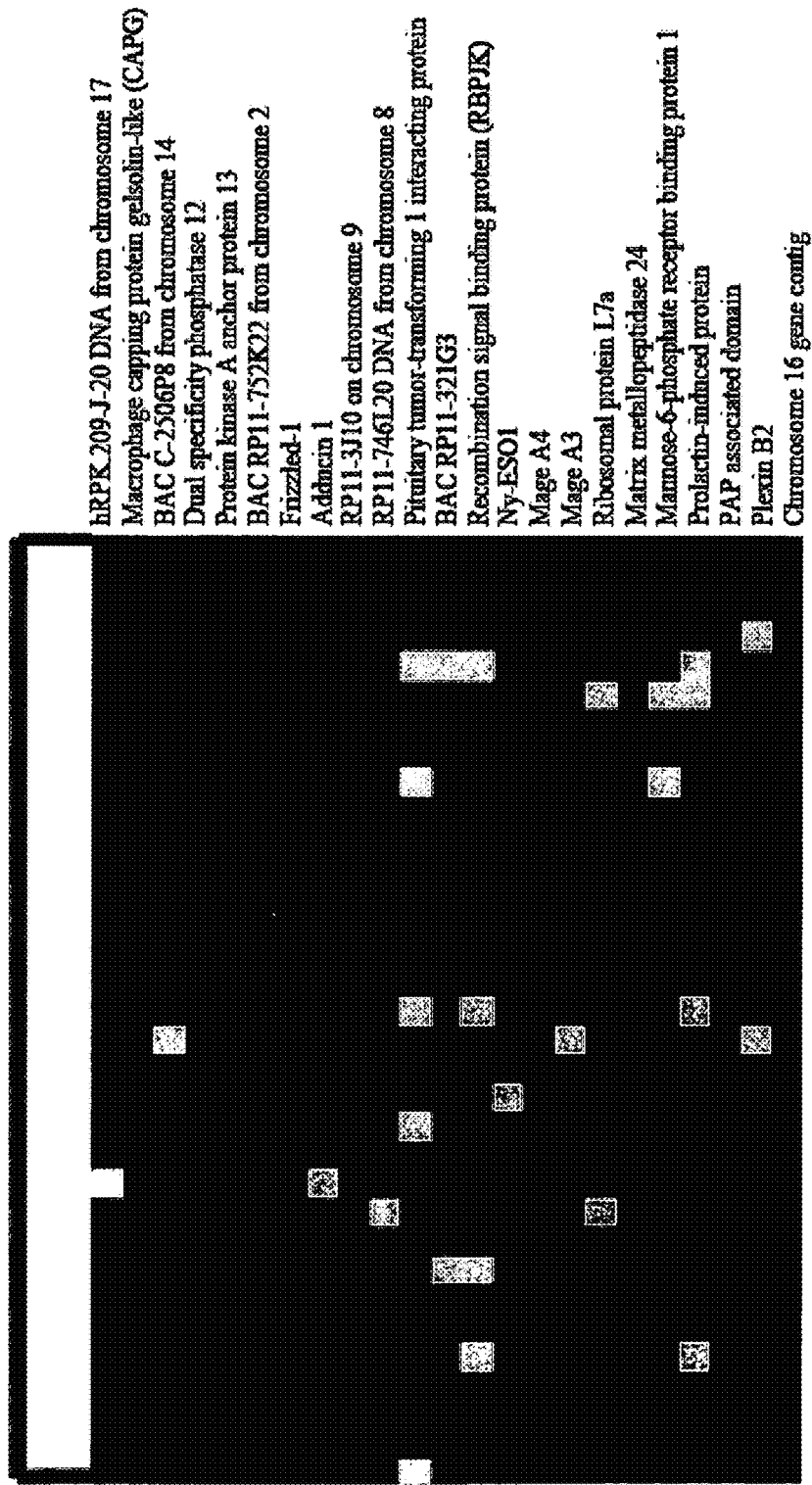
FIGS. 3A-3F, CONT'D.

DIAGNOSTIC EVALUATION OF ANTIBODY RESPONSES TO COMMONLY RECOGNIZED PROSTATE CANCER-ASSOCIATED ANTIGENS

CROSS-REFERENCE TO RELATED APPLICATION

This application is a continuation of U.S. application Ser. No. 13/088,594, filed Apr. 18, 2011, now abandoned, which claims the benefit of U.S. Provisional Patent Application No. 61/324,953, filed Apr. 16, 2010, each of which is incorporated herein by reference as if set forth in its entirety.

STATEMENT REGARDING FEDERALLY SPONSORED RESEARCH OR DEVELOPMENT

This invention was made with government support under RR016489 awarded by the National Institutes of Health. The government has certain rights in the invention.

SEQUENCE LISTING

A sequence listing is submitted in PDF and text formats on one Compact Disc-Read Only Memory (CD-ROM), in duplicate, and is incorporated herein by reference. "Copy 1" of the CD-ROM contains Seq List 960296_01933_ST25.PDF, created Dec. 23, 2015, 1620 KB and Seq List 960296_01933_ST25.TXT, created Dec. 23, 2015, 2695 KB. "Copy 2" of the CD-ROM contains Seq List 960296_01933_ST25.PDF, created Dec. 23, 2015, 1620 KB and Seq List 960296_01933_ST25.TXT, created Dec. 23, 2015, 2695 KB.

BACKGROUND

Prostate cancer is prevalent worldwide. Men living in the United States have approximately a 1 in 6 chance of being diagnosed with prostate cancer at some point during their lifetime, and approximately a 1 in 50 chance of dying from prostate cancer (Jemal et al., CA Cancer J. Clin. 59:225-249 (2009), incorporated herein by reference as if set forth in its entirety). The number of men afflicted with prostate cancer is increasing rapidly as the population of males over the age of 50 grows. Thus, strategies for detecting prostate cancer in its early stages are urgently needed.

Conventional prostate cancer screening methods, including digital rectal examination, transrectal ultrasound, and prostate specific antigen (PSA) testing, lack sensitivity and specificity. Elements of PSA screening are controversial: practitioners disagree on the best age for screening, how to interpret elevated PSA values, and how to identify prostate cancers in patients with low serum PSA values. There are also concerns that PSA screening may lead to unnecessary interventions that do not affect long-term outcome and survival (Greene et al., J Urol 182:2232-2241 (2009), incorporated herein by reference as if set forth in its entirety). To overcome the disadvantages of prostate cancer screening methods, researchers have attempted to identify antigens produced by tumor cells that can be utilized as prostate cancer markers. Serum-based screening methods have allowed for rapid identification of many tumor antigens in individuals with many different tumor types (Sahin et al., Proc. Nat. Acad. Sci. 92:11810-11813(1995), incorporated herein by reference as if set forth in its entirety). In fact, serum screening has been so successful that literally hundreds of cancer-associated antigenic proteins have been identified.

Serological identification of antigens by recombinant expression cloning (SEREX) has been used to prioritize potential vaccine targets for prostate cancer. Immunologically recognized proteins of the prostate have been identified by screening sera from: i) individuals with prostate cancer (Dunphy et al., Update Canc. Ther. 22:273-284 (2006); Fossa et al., Br. J. Cancer 83:743-749 (2000); Mooney et al., Int. J. Urol. 13:211-217 (2006)); ii) prostate cancer individuals treated with immune-active therapies (Dunphy et al., J. Immunother. 28:268-275 (2005)); and iii) prostate cancer individuals treated with standard androgen deprivation therapy (Morse and McNeel, Hum. Immunol. 71:496-504 (2010)); each of the foregoing references are herein incorporated by reference as if set forth in their entirety). Sera from individuals with prostate cancer were also used to directly screen a testis tissue cDNA expression library and a panel of defined cancer-testis antigens aberrantly expressed in solid tumors of different histologic types (Hoeppner et al., Cancer Immun. 6:1-7 (2006); Dubovsky and McNeel, Prostate 67:1781-1790 (2007), each incorporated herein by reference as if set forth in its entirety).

Chronic inflammation has been implicated in lung and colon cancers and might similarly promote the development of prostate cancers (Palapattu et al., Carcinogenesis 26:1170-1181 (2005); Narayanan et al., Prostate 69:133-141 (2009); McDowell et al., Prostate 70:377-389 (2010); Dennis et al., Urology 60:78-83 (2002); each incorporated herein by reference as if set forth in its entirety). Tumor-infiltrating lymphocytes are observed in prostate tumor specimens, and chronic inflammatory cells (e.g., lymphocytes and mononuclear cells) are observed adjacent to the earliest premalignant lesions of the prostate (De Marzo et al., Am. J. Pathol. 155:1985-1992 (1999) incorporated by reference herein as if set forth in its entirety). In rodents, chronic prostatitis appears to promote the development of prostate tumors (Gilardoni et al., J. Exp. Clin. Cancer Res. 18:493-504 (1999), incorporated by reference herein as if set forth in its entirety). Human prostate-infiltrating lymphocytes obtained at the time of surgery are oligoclonal suggesting that these lymphocytes recognize tissue-specific antigens (Mercader et al., Proc. Nat. Acad. Sci. 98:14565-14570 (2001); Sfanos et al., Prostate 69:1694-1703 (2009); each incorporated herein by reference as if set forth in its entirety).

While a number of antigens associated with prostate cancer have been identified, it has not yet been determined which of these antigens are predictive of a malignant or premalignant prostate. This is at least in part due to the variation in antibody-antigen profiles of individuals; not every antigen associated with prostate cancer or prostatitis is expressed in every affected individual and not every expressed antigen elicits an immune response in every affected individual. As such, no single antigen can serve as a reliable indicator of prostate cancer or prostatitis. The high level of variation of immunoresponsiveness among individuals has made it difficult to translate antigens associated with prostate cancer into tools useful for predicting prostate cancer, or predicting an increased risk of developing prostate cancer, in populations of men, wherein populations are defined as groups with or without a particular disease or disease stage. Screening men for all antigens that have been associated with prostate cancer is cost-prohibitive and impractical. Thus, there is a need in the art to identify a subset of antigens specific to antibodies associated with pre-malignant and malignant prostate tissue for identifying candidate individuals warranting further prostate examination.

BRIEF SUMMARY OF THE INVENTION

The present invention is broadly summarized as relating to a plurality of antigens that together form a set or panel of immunoreactive molecules suitable for identifying candidates for prostate cancer examination. Many cancer detection efforts rely on detecting, with varying degrees of specificity and sensitivity, cancer-associated antigens produced by tumor cells. In contrast, the present invention relies on detecting immunoresponses to tissue-associated antigens. The present invention contemplates using a plurality of these antigens to identify antibodies indicative of a pre-malignant or malignant prostate. As used herein, an "antigen" means a substance that when introduced into an animal stimulates the production of an antibody. An antigen can also be a substance produced by the body, wherein an immune response has been, or can be, elicited to that antigen. As used herein, an "antibody," is a specialized molecule that can specifically bind the antigen that triggered its production.

In a first aspect, the invention is summarized as an antigen panel for identifying immunoreactivity associated with a premalignant or malignant prostate, the panel comprising a plurality of antigens. As used herein, "immunoreactivity" refers to an animal's immune response to a particular antigen or antigens. One or more of the antigens may be previously known and identified as being recognized by antibodies in individuals having prostate cancer and/or prostatitis. In some embodiments of the first aspect, the panel elicits an immune response in at least about 33% of men with prostate cancer or prostatitis. In other embodiments of the first aspect, 9% of individuals with prostatitis or prostate cancer exhibit an immune response to at least three of the antigens in the panel. As use herein, "about" means within 5% of a stated range.

In some embodiments of the first aspect, the plurality of antigens in the antigen panel is selected from the group consisting of PRO1, PRO2, PRO3, PRO4, PRO5, PRO6, PRO7, PRO8, PRO9, PRO10, PRO11, PRO12, PRO13, PRO14, PRO15, PRO16, PRO17, PRO18, PRO19, PRO20, PRO21, PRO22, PRO23, PRO24, PRO25, PRO26, PRO27, PRO28, PRO29, PRO30, PRO31, PRO32, PRO33, PRO34, PRO35, PRO36, PRO37, PRO38, PRO39, PRO40, PRO41, CTA1, CTA2, CTA3, CTA4, CTA5, CTA6, CTA7, CTA5, CTA9, CTA10, CTA11, CTA12, CTA13, CTA14, CTA15, CTA16, CTA17, CTA18, CTA19, CTA20, CTA21, CTA22, CTA23, CTA24, CTA25, CTA26, CTA27, CTA28, CTA29, PCA1, PCA2, PCA3, PCA4, PCA5, PCA6, PCA7, PCA8, PCA9, PCA10, PCA11, PCA12, PCA13, PCA14, PCA15, PCA16, PCA17, PCA18, PCA19, PCA20, PCA21, PCA22, PCA23, PCA24, PCA25, PCA26, PCA27, PCA28, PCA29, PCA30, ADT1, ADT2, ADT3, ADT4, ADT5, ADT6, ADT7, ADT8, ADT9, ADT10, ADT11, ADT12, ADT13, ADT14, ADT15, ADT16, ADT17, ADT18, ADT19, ADT20, ADT21, ADT22, ADT23, ADT24, ADT25, ADT26, ADT27, and ADT28.

In another embodiment of the first aspect, the plurality of antigens in the panel includes ADT14, CTA3, CTA23, PCA6, PCA8, PCA10, PCA16, PRO5, PRO10, PRO12, PRO17, PRO18, PRO19, PRO20, PRO24, PRO25, PRO35, CTA27, PCA21, PRO40, PCA2, PRO34, and PRO32.

In a second aspect, the invention relates to a method for identifying human or non-human animals as candidates for prostate cancer examination. The method includes the steps of contacting an antigen panel as above with a sample containing at least one antibody specific to at least one antigen of the panel, and observing evidence of immunocomplex formation between at least one antibody from the sample and at least one antigen of the panel. As used herein, "immunocomplex" refers to a complex formed between an antibody and the antigen specifically recognized by the antibody. An individual is identified as a candidate if at least one immunocomplex forms between an antibody from the sample and an antigen in the panel. Samples appropriate for use in the method include, but are not limited to, tissues, cells, and bodily fluids, including blood.

In a third aspect, the present invention relates to a kit comprising an antibody detection panel. The kit comprises an antigen panel containing a plurality of antigens as disclosed herein optionally provided in a carrier or medium.

Unless otherwise defined, all technical and scientific terms used herein have the same meaning as commonly understood by one of ordinary skill in the art to which this invention belongs. Although suitable materials and methods for the practice or testing of the present invention are described below, other known materials and methods similar or equivalent to those described herein can be used.

Other objectives, advantages and features of the present invention will become apparent from the following specification taken in conjunction with the accompanying drawings.

BRIEF DESCRIPTION OF THE SEVERAL VIEWS OF THE DRAWINGS

FIG. 3A shows a heatmap analysis of the relative immunoreactivity for individual antigens indicated by spot color intensity (immunoreactive: white; intermediate: grey; not immunoreactive: black). FIGS. 3B-F illustrates a subset analysis for 23 antigens with the highest positive likelihood ratio values.

DETAILED DESCRIPTION OF PREFERRED EMBODIMENTS

Figure 1:
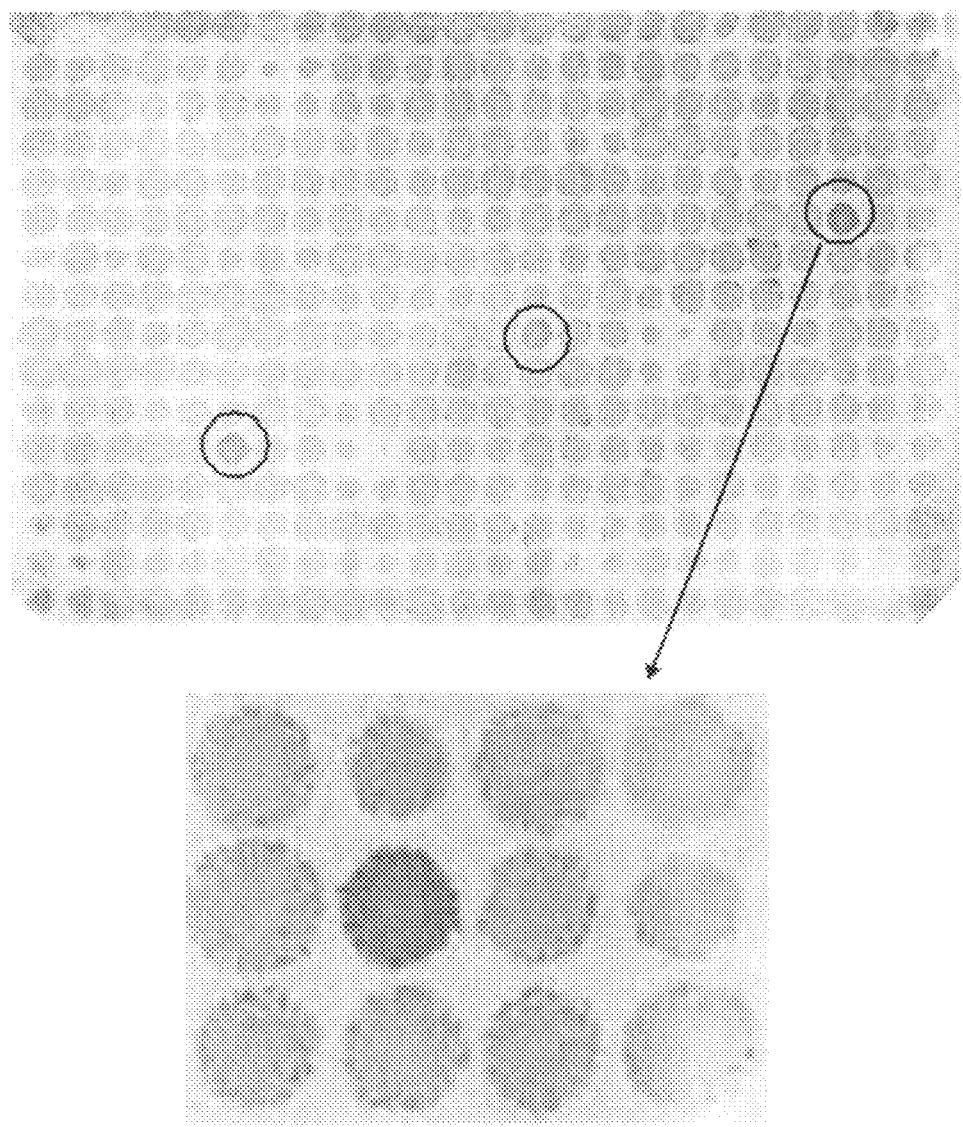
FIG. 1: illustrates high-throughput immunoblot analysis.
Figures 2A, 2B, 2C, 2D, 2E, 2F, 2G, 2H:
FIGS. 2A-2H: illustrate the mean relative density scores for healthy male control blood donors (n=25, open circles) and men with castrate-resistant prostate cancer (n=25, closed circles). Asterisks denote significantly higher median reactivity for the cancer population compared to the control population.

The present invention generally relates to a novel panel of a plurality of antigens for identifying immunoresponses associated with a premalignant or malignant prostate. As used herein, a "set" or a "panel" refers to a group of antigens associated with a premalignant or malignant prostate. As used herein, "immunoresponse" means the occurrence of a binding reaction between an antibody specific to an antigen and that antigen. As used herein, a premalignant prostate means a prostate characterized by tissue that is not yet malignant, but is poised to become malignant as evidenced by, for example, chronic inflammation or other conditions that can alter cell proliferation and/or cell death. Skilled artisans are familiar with conditions that are associated with changes in cell proliferation and conditions that are associated with changes in cell death. As used herein a malignant prostate refers to a prostate containing tumor-forming prostate epithelial cells.

In some embodiments, one or more of the antigens of the panel is associated with premalignant inflammation of the prostate. As used herein, "premalignant inflammation" means inflammation, the presence of which indicates an increase in an individual's risk for developing a malignant state or condition. Advantageously, the panel includes a plurality of antigens that make the panel more likely to detect immunoreactivity when exposed to antibody-containing samples compared to using a single antigen alone. In some preferred embodiments, antigens having higher specificity for prostate cancer are included in the panel, wherein relative specificity is based on receiver operating curve analysis. In other preferred embodiments, antigens with a positive likelihood ratio greater than 4 (sensitivity/(1−specificity)) are included in the panel. Sensitivity and specificity are based on immunoreactivity of a population of subjects with prostate disease relative to a control population. As used herein, "sensitivity" of an antigen refers to the proportion of positive subjects (i.e., subjects with prostate cancer or prostatitis) identified as positive by presence of an immunoresponse to a particular antigen in an assay. As used herein, "specificity" of an antigen refers to the proportion of negative subjects (i.e., control subjects without prostate cancer or prostatitis) identified as negative by absence of an immunoresponse to a particular antigen in an assay. The likelihood ratio used to rank antigens is a statistical model used to express how many times more likely a dataset is to fit one statistical model rather than another. For example, an antigen having a likelihood ratio of 4 is 4 times more likely to elicit an immunoresponse in a subject having prostatitis or prostate cancer relative to a patient lacking prostatitis or prostate cancer. An antigen can be a natural or synthetic protein or fragment thereof, polysaccharide, or nucleic acid. Skilled artisans know that antigens can induce an immune response and elicit antibody formation. Antibodies can be molecules synthesized in response to the presence of a foreign substance, wherein each antibody has specific affinity for the foreign material that stimulated its synthesis. The specific affinity of an antibody need not be for the entire molecular antigen, but for a particular site on it called the epitope (Kindt et al., Kuby Immunology, 6th Edition 574 pps, (2006), incorporated herein by reference as if set forth in its entirety). Antibodies can be, for example, a natural or synthetic protein or fragment thereof, or nucleic acids (e.g., aptamers) with protein-binding or other antigen-binding characteristics. Antibodies can be produced in response to antigenic stimuli including, but not limited to, exposure to foreign proteins, microorganisms, and toxins. When the panel is contacted with a sample containing at least one antibody specific to an antigen in the panel, an immunocomplex forms between the antigen and the antibody specific for the antigen. One of ordinary skill in the art can assess antigen-antibody imunocomplex formation by techniques commonly used in the art. Examples of suitable techniques to assess immunocomplex formation include phage immunoblot, ELISA, and radioimmunoassay. See, e.g., (Dubovsky et al., J. Immunother. 30:675-683 (2007), incorporated herein by reference as if set forth in its entirety). Samples suitable for use with the method include tissues, cells, and bodily fluids. Preferably, the sample is serum.

In a preferred embodiment, at least about 38% of individuals who have prostate cancer and at least about 33% of individuals who have prostatitis are immunoreactive to at least one antigen of the panel. In another preferred embodiment, at least about 10% of individuals who have prostate cancer and at least about 9% of individuals who have prostatitis are immunoreactive to at least three antigens of the panel. In still another preferred embodiment, antigens of the panel are selected based on their capacity in aggregate to elicit an immune response in at least about 33% of individuals with prostatitis or prostate cancer.

Prostate cancer-relevant cancer-testis antigens (CTA) normally expressed only in MHC class I-deficient germ cells but aberrantly expressed in solid tumors of various histologic types, are suitable for use in the panel. Suitable CTA antigens include, but are not limited to, CTA1, CTA2, CTA3, CTA4, CTA5, CTA6, CTA7, CTA5, CTA9, CTA10, CTA11, CTA12, CTA13, CTA14, CTA15, CTA16, CTA17, CTA18, CTA19, CTA20, CTA21, CTA22, CTA23, CTA24, CTA25, CTA26, CTA27, CTA28, and CTA29. Antigens identified in prostate cancer individuals treated with androgen deprivation therapy (ADT) are also suitable for use in this panel. Suitable ADT antigens include, but are not limited to, ADT1, ADT2, ADT3, ADT4, ADT5, ADT6, ADT7, ADT8, ADT9, ADT10, ADT11, ADT12, ADT13, ADT14, ADT15, ADT16, ADT17, ADT18, ADT19, ADT20, ADT21, ADT22, ADT23, ADT24, ADT25, ADT26, ADT27, and ADT28. Antigens identified in prostate cancer individuals treated with non-ADT prostate cancer therapies (PCA) are also suitable for use in this panel. Suitable PCA antigens include but are not limited to, PCA1, PCA2, PCA3, PCA4, PCA5, PCA6, PCA7, PCA8, PCA9, PCA10, PCA11, PCA12, PCA13, PCA14, PCA15, PCA16, PCA17, PCA18, PCA19, PCA20, PCA21, PCA22, PCA23, PCA24, PCA25, PCA26, PCA27, PCA28, PCA29, and PCA30. Alternatively, antigens identified in subjects with chronic prostatitis (PRO) are suitable for use in this panel. Suitable PRO antigens include, but are not limited to, PRO1, PRO2, PRO3, PRO4, PRO5, PRO6, PRO7, PRO5, PRO9, PRO10, PROM PRO12, PRO13, PRO14, PRO15, PRO16, PRO17, PRO18, PRO19, PRO20, PRO21, PRO22, PRO23, PRO24, PRO25, PRO26, PRO27, PRO28, PRO29, PRO30, PRO31, PRO32, PRO33, PRO34, PRO35, PRO36, PRO37, PRO38, PRO39, PRO40, and PRO41. Exemplary conditions for preparing antigens having epitopes specifically recognized by antibodies specific to the epitopes, are well-known by those of ordinary skill in the art.

In a preferred embodiment, the panel includes ADT14, CTA3, CTA23, PCA6, PCA8, PCA10, PCA16, PRO5, PRO10, PRO12, PRO17, PRO18, PRO19, PRO20, PRO24, PRO25, PRO35, CTA27, PCA21, PRO40, PCA2, PRO34, and PRO32. Omitting one or more of these antigens from the panel might affect the panel's sensitivity. Similarly, adding one or more antigen to this panel might affect the panel's sensitivity. However, a skilled artisan understands that increasing or decreasing the number of antigens in this preferred panel might still provide an acceptable panel of antigens for identifying candidates for further prostate cancer examination.

In another preferred embodiment, the panel includes antigens that have a high likelihood of eliciting immunoresponses in subjects who are candidates for further prostate cancer examination, relative to subjects who are not candidates for further prostate examination, as measured by positive likelihood ratio. In some of these preferred embodiments, antigens of the panel have a positive likelihood ratio of at least 4 (sensitivity/(1−specificity)).

In another embodiment, the present invention provides a method for identifying individuals as candidates for further prostate cancer examination. In the method, a panel is contacted with a sample containing one or more antibodies under conditions suitable for antigen-antibody immunocomplex formation. The skilled artisan knows exemplary conditions to allow high-affinity antigen-antibody binding (e.g., Dubrovsky et al., 2007 supra). In the method, presence of an immunocomplex indicates that the individual from whom the sample was obtained is a candidate for further prostate cancer examination.

The disclosed methods can be performed in a single or multi-well format in which each one of the plurality of antigens is placed in a separate well of a multi-well assay plate or, alternatively, in a single container format in which the entire panel of antigens is placed in a single well. The method may be performed in a qualitative format to detect the presence or absence of immunocomplexes, or in a quantitative format to provide a quantitative measurement of the antibodies in a sample. Exemplary conditions used to assay antigens of the inventive panel are well-known by those of ordinary skill in the art.

In another embodiment, the antigen panel can be provided as part of a kit containing a carrier or medium suitable for antigen storage.

The invention will be more fully understood upon consideration of the following non-limiting Examples.

EXAMPLES

Example 1: Diagnostic Evaluation of Antibody Responses to Prostate Cancer-Associated Antigens Multiple antigens were evaluated to identify a subset of immunoreactive antigens in humans with prostate disease. IgG responses were evaluated in subjects with prostate cancer, chronic prostatitis, and in men without prostate disease using phage immunoblot methodology. Results indicated that subjects with prostate cancer or prostatitis have antibodies specific for multiple common antigens: of 128 proteins tested, a subset containing 23 proteins was identified to which antibodies were detected in 38% of subjects with prostate cancer and 33% subjects with prostatitis versus 6% of controls. These results suggest an association between inflammatory conditions of the prostate and prostate cancer, and suggest that antibody responses to a panel of commonly-recognized prostate antigens can be used to identify subjects at risk for prostate cancer.

Materials and Methods

High Throughput Immunoblot (HTI):

Phage immunoblot analysis was performed essentially as described by Dubovsky et al., J Immunother 30:675-683 (2007), incorporated by reference herein as if set forth in its entirety. Briefly, panels of 128 lambda phage encoding unique prostate-associated antigens were assembled (Table I). Phage included those antigens initially identified in individuals with prostate cancer or chronic prostatitis by SEREX (Dunphy et al., 2004 supra; Dunphy et al., 2005, supra; Morse and McNeel, 2010 supra; Hoeppner et al., 2006 supra), or were constructed to express specific genes of interest based on prior studies (Dubovsky et al., 2007 supra; Olson and McNeel, Prostate 67:1729-1739 (2007) incorporated herein by reference as if set forth in its entirety). The following antigens were included in the panel: 29 cancer-testis antigens (CTA), 41 antigens identified in individuals with chronic prostatitis (PRO), 28 antigens identified in individuals treated with androgen deprivation (ADT), and 30 antigens identified in individuals treated with other therapies (PCA).

100,000 pfu lambda phage each carrying a gene that encodes one of the 128 antigens of the panel were robotically spotted in triplicate in a 16×24 array onto lawns of $E.$ $coli$ (XL-1 blue strain) growing in agar-containing Omni-Tray plates. Replicates for individual antigens were staggered in position across the array to account for regional variation on individual filters. For initial studies, phage encoding human immunoglobulin G (IgG) were included as a positive control and empty phage constructs were similarly included as a negative control. Plates were allowed to dry at room temperature for 20 minutes and incubated at 37° C. for 4 hours after which nitrocellulose membranes suffused with 10-mM isopropyl β-D-thiogalactopyranoside (IPTG) (Fisher Scientific, Pittsburgh, Pa.) were overlaid. Plates were incubated at 37° C. overnight to allow for recombinant expression of the antigen encoded by the protein. After 16-20 hours, membranes were removed, washed twice in TBST (50 mM Tris pH 7.2, 100 mM NaCl, 0.5% Tween-20) for 10 minutes and once in TBS (50 mM Tris pH 7.2, 100 mM NaCl) for an additional 10 minutes. Membranes were blocked in blocking solution (TBST+1% BSA), and incubated at 4° C. with human sera (diluted 1:100 in blocking solution) overnight. Membranes were washed the following day and blocked prior to incubation with a mouse anti-human IgG antibody conjugated to alkaline phosphatase (Sigma, St. Louis, Mo.) to detect human IgG. Membranes were washed again and incubated in 0.3 mg/mL nitro blue tetrazolium chloride (NBT) (Fisher Scientific) and 0.15 mg/mL 5-bromo 4-chloro 3-indoylphosphate (BCIP) (Fisher Scientific) in 100-mM Tris 9.5, 100-mM NaCl, and 5-mM $MgCl_2$ to detect immunoreactivity. Membranes were washed with large volumes of deionized water and dried at room temperature prior to evaluation.

Membranes were scanned using a color image scanner and the digital format aligned with a 16×24 grid using densitometry software (ImageQuant TL, Amersham Biosciences, GE Healthcare Life Sciences, Piscataway, N.J.). For initial studies, immunoreactivity was quantified by measuring the density at each spot; values of replicates for individual antigens were averaged. Background correction was then made by subtracting the average of empty phage construct replicate densities on individual membrane and normalized by dividing by the average of IgG positive control replicate densities on each membrane. Transformation of densitometry data resulted in density values for individual antigens relative to a negative control and a positive control (set at 0.0 and 1.0 respectively). For subsequent studies, immunoreactivity was judged as "positive" or "negative" by visual inspection, as previously described (Dunphy et al., J. Clin. Immunol. 24:492-501 (2004), incorporated herein by reference as if set forth in its entirety; Dubovsky et al., 2007 supra). Briefly, four independent individuals looked at each membrane and scored individual spots as immunoreactive or not reactive by visually comparing each spot to a negative control. Antigens for which 0-1 of replicates determined immunoreactive with individual sera were defined as negative for immunoreactivity, and for which 2-3 of the replicates determined immunoreactive were defined as positive.

TABLE I

One embodiment of the antigen panel.

| Designation | GenBank Accession | SEQ ID NO: | Gene name |
|---|---|---|---|
| PRO1 | NM_006423.1 | 1 | Rab acceptor |
| PRO2 | NM_007124.1 | 2 | U-trophon |
| PRO3 | NM_000484.1 | 3 | Amyloid Beta (4) precursor protein |
| PRO4 | NM_002709.1 | 4 | Protein Phosphatase 1 |
| PRO5 | AC005822.1 | 5 | hRPK.209-J-20 DNA from chromosome 17 |
| PRO6 | AF308301.1/ NM_030811.2 | 6 | NY-BR-87/Ribosomal protein S26 |
| PRO7 | NM_014761.1 | 7 | KIAA0174 from chromosome 16 |
| PRO8 | AF273042.1 | 8 | Cutaneous T cell lymphoma tumor antigen sel-1 |
| PRO9 | AK096728.1 | 9 | FLJ39409 Cdna |
| PRO10 | NM_001747.1 | 10 | Macrophage capping protein gelsolin-like (CAPG) |
| PRO11 | NM_000717.2 | 11 | Carbonic anhydrase IV |
| PRO12 | AL136040.5 | 12 | BAC C-2506P8 from chromosome 14 |
| PRO13 | AC084864.4 | 13 | RP11-738B7 DNA from chromosome 7 |
| PRO14 | NM_001813.1 | 14 | Centromere protein E |
| PRO15 | M27274.1 | 15 | Prostate specific antigen (PSA) |
| PRO16 | NM_012116.2 | 16 | Cas-Br-M ecotropic retroviral transforming sequence c (CBLC) |
| PRO17 | BC006286.1 | 17 | Dual specificity phosphatase 12 |
| PRO18 | NM_144767.1/ BC017368.1/ AF126008.1 | 18 | Protein kinase A anchor protein 13/ lymphoid blast crisis oncogene/ breast cancer nuclear receptor-binding auxiliary protein (BRX) |
| PRO19 | AC073879.7 | 19 | BAC RP11-752K22 from chromosome 2 |
| PRO20 | AB017363.1 | 20 | Frizzled-1 |
| PRO21 | AL365273.25 | 21 | RP11-429G19 DNA from chromosome 10 |
| PRO22 | XM_047011.2 | 22 | o-fucosyltansferase |
| PRO23 | NM_017582.3 | 23 | NICE5 |
| PRO24 | NM_014190.1 | 24 | Adducin 1 |
| PRO25 | AL138752.5 | 25 | RP11-3J10 on chromosome 9 |
| PRO26 | BC024007.1 | 26 | Chitobiase |
| PRO27 | AK001572.1 | 27 | FLJ10710 cDNA |
| PRO28 | AL356915.19 | 28 | RP11-3J10 on chromosome 13 |
| PRO29 | NM_006117.1/ AF257175.1 | 29 | Peroxisomal D3, D2 enoyl CoA isomerase/Hepatocellular carcinoma associated antigen 64 |
| PRO30 | XM_033511.8 | 30 | Helicase with SNF2 domain |
| PRO31 | AF039689.1/ XM_083939.1/ AF432221.1 | 31 | NY-CO-7/STUB1/CLL-associated antigen KW-8 |
| PRO32 | AC021558.10 | 32 | RP11-746L20 DNA from chromosome 8 |
| PRO33 | NM_031946.2 | 33 | Centaurin gamma 3 |
| PRO34 | BC034250.1 | 34 | Pituitary tumor-transforming 1 interacting protein |
| PRO35 | AC069506.14 | 35 | BAC RP11-321G3 |
| PRO36 | AC011489.6 | 36 | CTB-179K24 DNA on chromosome 19 |
| PRO37 | NM_032415.2 | 37 | Caspase domain recruitment (CARD11) |
| PRO38 | NM_003379.3 | 38 | Cytovillin 2 |
| PRO39 | BC029529.1 | 39 | Beta tubulin |
| PRO40 | L07872.1 | 40 | Recombination signal binding protein (RBPJK) |
| PRO41 | NM_006455.1 | 41 | Nucleolar autoantigen/MAD-Pro-34 |
| CTA1 | NM_004988 | 42 | Mage A1 |
| CTA2 | BC007343 | 43 | SSX-2 |
| CTA3 | AJ003149 | 44 | Ny-ESO1 |
| CTA4 | NM_021123 | 45 | Gage 7 |
| CTA5 | U90841 | 46 | SSX-4 |
| CTA6 | BC015020 | 47 | NXF-2 |
| CTA7 | BC022011 | 48 | TPX 1 |
| CTA8 | BC009538 | 49 | Xage 1 |
| CTA9 | BC002833 | 50 | Lage 1 |
| CTA10 | BC010897 | 51 | Page 1 |
| CTA11 | BC081566 | 52 | Mage E1 |
| CTA12 | BC054023 | 53 | Span XC |
| CTA13 | BC064547 | 54 | Adam 2 |
| CTA14 | BC037775 | 55 | TSP 50 |
| CTA15 | BC034320 | 56 | NY-SAR 35 |
| CTA16 | BC022064 | 57 | Fate 1 |
| CTA17 | BC009230 | 58 | Page 5 |
| CTA18 | BC023635 | 59 | Lip1 |
| CTA19 | BC032457 | 60 | SPA17 |
| CTA20 | BE387798 | 61 | Mage A8 |
| CTA21 | BE897525 | 62 | Mage B1 |
| CTA22 | BC026071 | 63 | Mage B2 |
| CTA23 | BC017723 | 64 | Mage A4 |
| CTA24 | BC001003 | 65 | SSX-1 |
| CTA25 | BC069397 | 66 | Gage 2 |
| CTA26 | BC069470 | 67 | Gage 4 |
| CTA27 | BC016803 | 68 | Mage A3 |
| CTA28 | NM_002762 | 69 | MAD-CT-1 |
| CTA29 | AK097414 | 70 | MAD-CT-2 |
| PCA1 | NM_025161.4 | 71 | Chromosome 17 gene contig. |
| PCA2 | NM_000972.2 | 72 | Ribosomal protein L7a |
| PCA3 | NM_152636.2 | 73 | Chromosome 12 gene contig. |
| PCA4 | NM_001134194.1 | 74 | Prostatic acid phosphatase |
| PCA5 | NM_003291.2 | 75 | Tripeptidyl peptidase II |
| PCA6 | NM_006690.3 | 76 | Matrix metallopeptidase 24 |
| PCA7 | NM_000990.4 | 77 | Ribosomal protein L27a |
| PCA8 | NM_002652.2 | 78 | Prolactin-induced protein |
| PCA9 | NM_005349.2 | 79 | Immunoglobulin Kappa J region |
| PCA10 | NM_005817.2 | 80 | Mannose-6-phosphate receptor binding protein 1 |
| PCA11 | NM_013267.2 | 81 | Glutaminase 2 |
| PCA12 | NM_018979.2 | 82 | WNK lysine deficient protein kinase 1 |
| PCA13 | NM_020718.3 | 83 | Ubiquitin specific peptidase 31 |
| PCA14 | NM_003007.2 | 84 | Semenogelin I, transcript variant 1 |
| PCA15 | NM_022735.3 | 85 | Acyl-coenzyme A binding domain containing 3 |
| PCA16 | NM_001040284.1 | 86 | PAP associated domain |
| PCA17 | NM_020187.2 | 87 | Chromosome 3 gene contig. |
| PCA18 | NM_002712.1 | 88 | Protein phosphatase 3, regulatory subunit 7 |
| PCA19 | NM_014220.2 | 89 | Transmembrane 4 L6 family member 1 |
| PCA20 | NM_001135592.1 | 90 | Ribosomal protein S27a |
| PCA21 | NM_012401.2 | 91 | Plexin B2 |
| PCA22 | NM_000985.3 | 92 | Ribosomal protein L17 |
| PCA23 | NM_080608.3 | 93 | Chromosome 20 gene contig. |
| PCA24 | NM_005165.2 | 94 | Aldolase C |
| PCA25 | NM_000969.3 | 95 | Ribosomal protein L5 |
| PCA26 | NM_001958.2 | 96 | Eukaryotic translation elongation factor 1 alpha 1 |
| PCA27 | NM_025108.2 | 97 | Chromosome 16 gene contig. |
| PCA28 | NM_015358.2 | 98 | Zinc-finger protein, CW type with coiled-coil domain 3 |
| PCA29 | NM_001130410.1 | 99 | Acetyl-coenzyme A acyltransferase 1 |
| PCA30 | NM_000044.2 | 100 | Androgen receptor ligand-binding domain |
| ADT1 | NM_004759.3 | 101 | Mitogen-activated protein kinase-activated protein kinase 2 |
| ADT2 | NM_001103.2 | 102 | Actinin alpha 2 |
| ADT3 | NM_002518.3 | 103 | Neuronal PAS domain protein 2 (NPAS2) |
| ADT4 | NM_033138.2 | 104 | Caldesmon 1 (CALD1) |
| ADT5 | NM_001459.2 | 105 | fms-related tyrosine kinase 3 ligand |
| ADT6 | NM_022474.2 | 106 | Membrane protein, palmitoylated 5 (MAGUK p55 subfamily member 5) |
| ADT7 | NM_006022.2 | 107 | TSC22 domain family, member 1 (TSC22D1) |
| ADT8 | NM_001001522.1 | 108 | Transgelin |
| ADT9 | NM_022758.4 | 109 | Chromosome 6 gene contig |
| ADT10 | NM_002695.3 | 110 | polymerase (RNA) II (DNA directed) polypeptide E (POLR2E) |

TABLE I-continued

One embodiment of the antigen panel.

| Designation | GenBank Accession | SEQ ID NO: | Gene name |
|---|---|---|---|
| ADT11 | NM_001018160.1 | 111 | NEDD8 activating enzyme subunit 1 (NAE1) |
| ADT12 | NM_015313.1 | 112 | Rho guanine nucleotide exchange factor 12 (ARHGEF12) |
| ADT13 | NM_152374.1 | 113 | Chromosome 1 gene contig |
| ADT14 | NM_001100873.1 | 114 | Chromosome 16 gene contig |
| ADT15 | NM_001136204.1 | 115 | Regulator of chromosome condensation 2 (RCC2) |
| ADT16 | NT_006713.15 | 116 | Chromosome 5 gene contig (splicing factor, arginine/serine-rich 12) |
| ADT17 | NM_025157.3 | 117 | Paxillin (PXN) |
| ADT18 | NM_016143.2 | 118 | NSFL1 (p97) cofactor (p47) NSFL1C |
| ADT19 | NM_004913.2 | 119 | Chromosome 16 gene contig |
| ADT20 | NM_207356.2 | 120 | Chromosome 1 gene contig |
| ADT21 | NM_003104.4 | 121 | Sorbitol dehydrogenase (SORD) |
| ADT22 | NT_006316.16 | 122 | Chromosome 4 gene contig (solute carrier family 2, facilitated glucose transporter) |
| ADT23 | NM_013336.3 | 123 | Sec 61 alpha 1 subunit |
| ADT24 | NM_002474.2 | 124 | Myosin heavy chain 11 (MYH11) |
| ADT25 | NR_002819.2 | 125 | Metastasis associated lung adenocarcinoma transcript 1 (MALAT1) |
| ADT26 | NM_001012321.1 | 126 | Similar to lamanin receptor 1 (ribosomal protein SA (RPSA), from chromosome 19) |
| ADT27 | NT_009952.14 | 127 | Chromosome 13 gene contig (heparan-sulfate 6-O-sulfotransferase 3) |
| ADT28 | NM_021239.2 | 128 | RNA binding motif protein 25 (RBM 25) |

Statistical Analyses:

Data collected from preliminary studies analyzing individuals with castrate-resistant prostate cancer and normal male blood donors were plotted as relative density values representing detection of antibodies specific to 125 prostate cancer-associated antigens for individual individuals. Median relative density values for individual antigens were calculated in both castrate-resistant prostate cancer samples and normal control samples and the non-parametric Wilcoxon Rank Sum test was used to compare the medians of the two groups. The Benjamini-Hochberg False-Discovery Rate (FDR) method for multiple testing was used to control the type I error (Benjamini et al., J. Roy. Stat. Soc. B (Method) 57:289-300 (1995) incorporated by reference herein as if set forth in its entirety). The frequencies of IgG responses were compared between populations using Fisher's exact test. Receiver Operating Curve (ROC) analysis was performed to identify a subset of prostate cancer-associated antigens with the highest predictive value for detecting prostate cancer cases when compared to normal controls. The positive likelihood ratio value was used to quantify the predictive value for individual markers. The proportions of individuals with at least one positive IgG response and the proportions of individuals with at least three positive IgG responses in the subset of predictive markers were compared between populations by performing logistic regression analysis where population groups were included as factors. Dunnett's multiple testing procedure was used to compare the proportions between the individual populations and the control (normal) group. All p-values are two-sided, with $p<0.05$ indicating statistically significant differences. The data analysis was performed using SAS® version 9.2 software (SAS Corp., Cary, N.C.).

Individual Populations:

Sera were obtained from individuals with chronic prostatitis (n=45, median age 42, age range 19-62), prostate cancer (n=151, median age 67, age range 44-86), and men without a history of known prostate disease (n=78, median age 32, age range 18-62). Among the individuals with prostate cancer, 18 were collected from individuals at the time of diagnosis prior to definitive radiation treatment or prostatectomy (pretreatment), 32 were collected from individuals after definitive treatment without evidence of disease recurrence (limited stage), 44 were collected from individuals with metastatic disease recurrence on androgen deprivation therapy (androgen-dependent), and 57 were collected from individuals with castrate-resistant, metastatic disease. Sera were also obtained from male individuals with other cancers (melanoma, n=4; renal, n=17; testicular, n=5; other, n=5; median age 58, age range 30-74) for use as controls. All subjects gave written Institutional Review Board-approved consent for the use of their blood for immunological studies. Blood was collected at the University of Wisconsin-Madison Hospital and Clinics (Madison, Wis.) or at the University of Washington Medical Center (Seattle, Wash.), and sera were stored in aliquots at −20° C. to −80° C. until used for analysis.

Results

Individuals with Prostate Cancer have Higher Frequencies of Detectable Antibodies Specific for Prostate Cancer-Associated Antigens than Men without Cancer.

To determine if specific antigens are commonly recognized in the sera of individuals with prostate cancer, and if a particular set of antigens is more frequently recognized than other antigen sets, phage encoding 125 unique, prostate cancer-associated antigens obtained from prior studies (Table I) were spotted in replicate onto bacterial lawns, transferred to nitrocellulose membranes, and probed with individual sera samples, as illustrated in FIG. 1. IgG specific for phage-encoded plaques were detected using a mouse anti-human IgG antibody, immunoreactivity was quantified by densitometry, and then normalized to internal controls (0=reactivity equivalent to phage not encoding a protein; 1=reactivity equivalent to phage encoding human IgG). Immunoreactivity to multiple antigens was detected in the individual population sampled (i.e., individuals with castrate-resistant metastatic prostate cancer) that was absent in the sera of 25 healthy male blood donors (FIG. 2A-H). Of the 125 antigens evaluated, median antibody responses to 27 (22%) antigens were significantly higher in the sera of individuals with prostate cancer compared with controls ($p<0.05$, Wilcoxon Rank Sum test, FIG. 2A-H). Of these 27 antigens, 22 were previously identified in individuals with chronic prostatitis.

Antibody Responses to Antigens of the Antigen Panel are Evident in Individuals with Early and Late Stages of Prostate Cancer and in Individuals with Prostatitis.

To determine if recognition of particular antigens distinguishes individuals with prostate cancer from individuals with prostatitis or from men without known prostate disease, sera from a larger population of healthy male control blood donors (n=53), individuals with chronic prostatitis (n=45), and individuals with different stages of prostate cancer (n=126) were analyzed. Serum samples were obtained from men with newly diagnosed prostate cancer (pre-treatment, n=18), individuals with treated disease and no evidence of recurrence (n=32), individuals with metastatic disease responsive to androgen deprivation therapy (n=44), and additional individuals with castrate-resistant metastatic disease (n=32). In addition, the panel of antigens was modified to exclude two antigens (Pro39 and ADT28) not immunologically recognized in the initial screen, and to include phage containing genes that encoded three additional antigens (Mad-Pro-30, SEQ ID NO: 30; Mad-Pro-34, SEQ ID NO: 34; and the androgen receptor ligand-binding domain, SEQ ID NO:129) that had previously been identified as immunologically recognized antigens (Dunphy et al., 2004 supra; Olson and McNeel, 2007 supra). To account for background reactivity of individual membranes and variability in plaque immunoreactivity, each of the replicate individual plaques was visually scored as immunoreactive or not.

Figures 3A, 3B, 3C, 3D, 3E, 3F:
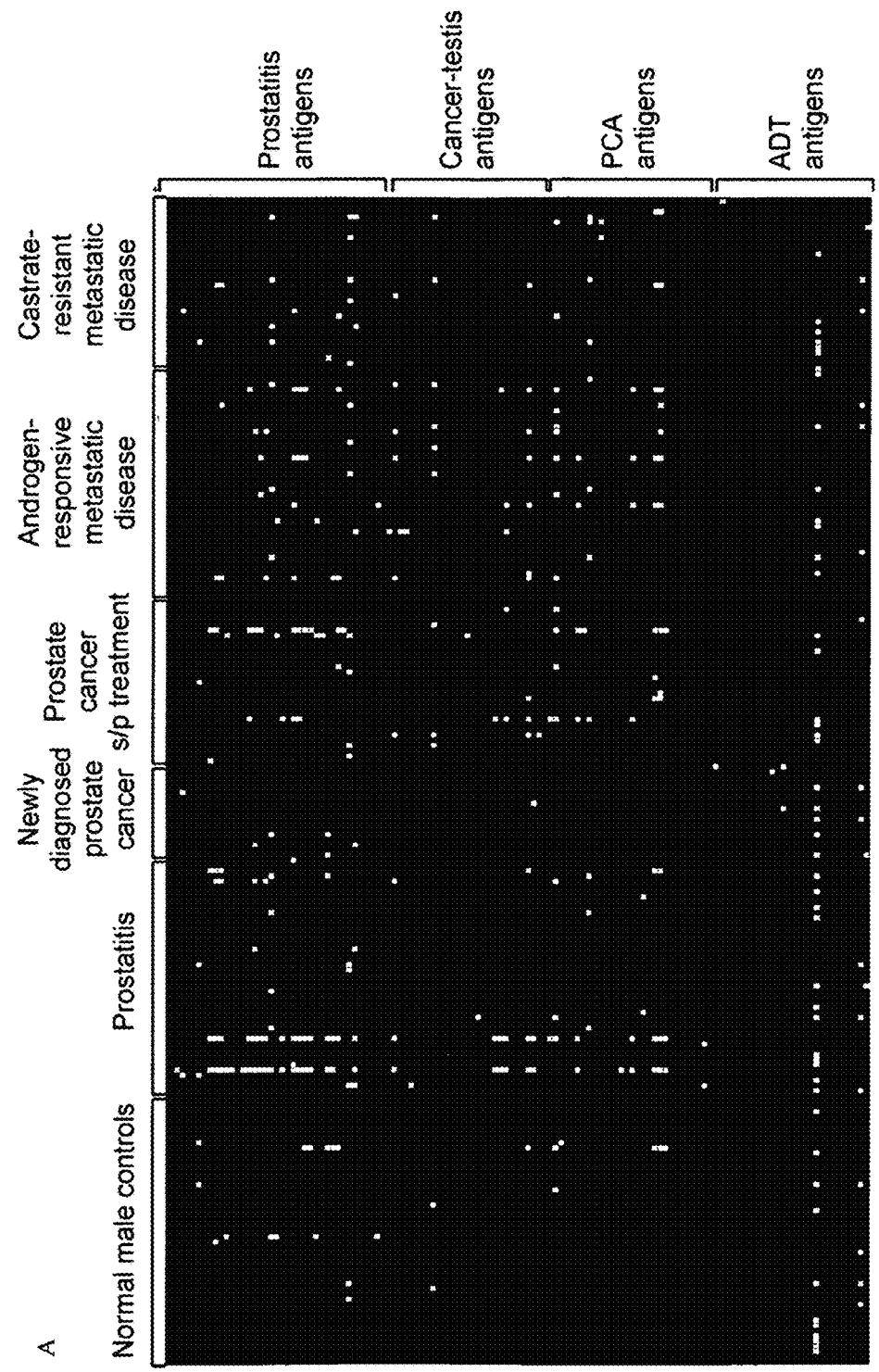
FIGS. 3A-3F illustrate immunoreactivity of individuals with early and late stages of prostate cancer.

As demonstrated in FIG. 3A, immunoreactivity to multiple antigens was identified. FIG. 3A shows a heatmap depicting relative immunoreactivity for each antigen, grouped by the study from which the antigens were originally identified, and for each individual or control group. Spots are graded in color intensity from 3 of 3 replicates visually immunoreactive (white), to 2 of 3 (grey), to not immunoreactive (black). Overall, however, responses to at least one antigen were not more frequently observed in the individual population (72/126, 57%) or prostatitis population (28/45, 62%) compared with the control population (22/53, 42%; p=0.11 and p=0.08, respectively). We identified no single antigen to which immunoreactivity was significantly more frequent in the individual population than in the control population. Instead, 23 antigens with high (>4) positive likelihood ratio values were identified based on a ROC analysis of IgG responses to antigens among prostate cancer individual samples compared to control individual samples (Table II). FIG. 3B-F shows a subset analysis for the 23 antigens with the highest positive likelihood ratio values when comparing prostate cancer cases to normal control cases.

TABLE II

One embodiment of the antigen panel. Shown is the subset of lambda phage-encoded antigens with the highest specificity for prostate cancer based on receiver operating curve analysis (see also FIG. 3B-F). Antigens with a positive likelihood ratio > 4 (sensitivity/(1-specificity)) are included, and the positive likelihood ratio is shown.

| Designation | Positive Likelihood Ratio | SEQ ID NO: | Gene name |
|---|---|---|---|
| ADT14 | ∞ | 114 | Chromosome 16 gene contig |
| CTA3 | ∞ | 44 | NY-ESO-1 |
| CTA23 | ∞ | 64 | Mage A4 |
| PCA6 | ∞ | 76 | Matrix metallopeptidase 24 |
| PCA 8 | ∞ | 78 | Prolactin-induced protein |
| PCA 10 | ∞ | 80 | Mannose-6-phosphate receptor binding protein 1 |
| PCA 16 | ∞ | 86 | PAP-associated domain |
| PRO5 | ∞ | 5 | hRPK.209-J-20 DNA from chromosome 17 |
| PRO 10 | ∞ | 10 | Macrophage capping protein gelsolin-like (CAPG) |
| PRO 12 | ∞ | 12 | BAC C-2506P8 from chromosome 14 |
| PRO 17 | ∞ | 17 | Dual specificity phosphatase 12 |
| PRO 18 | ∞ | 18 | Protein kinase A anchor protein 13/lymphoid blast crisis oncogene/breast cancer nuclear receptor-binding auxiliary protein (BRX) |
| PRO 19 | ∞ | 19 | BAC RP11-752K22 from chromosome 2 |
| PRO 20 | ∞ | 20 | Frizzled-1 |
| PRO 24 | ∞ | 24 | Adducin 1 |
| PRO 25 | ∞ | 25 | RP11-3J10 on chromosome 9 |
| PRO 35 | ∞ | 35 | BAC RP11-321G3 |
| CTA27 | 8.4 | 68 | Mage A3 |
| PCA 21 | 8.4 | 91 | Plexin B2 |

TABLE II-continued

One embodiment of the antigen panel. Shown is the subset of lambda phage-encoded antigens with the highest specificity for prostate cancer based on receiver operating curve analysis (see also FIG. 3B-F). Antigens with a positive likelihood ratio > 4 (sensitivity/(1-specificity)) are included, and the positive likelihood ratio is shown.

| Designation | Positive Likelihood Ratio | SEQ ID NO: | Gene name |
|---|---|---|---|
| PRO 40 | 6.7 | 40 | Recombination signal binding protein (RBPJK) |
| PCA 2 | 5.5 | 72 | Ribosomal protein L7a |
| PRO 34 | 5.4 | 34 | Pituitary tumor-transforming 1 interacting protein |
| PRO 32 | 4.2 | 32 | RP11-746L20 DNA from chromosome 8 |

Antibody Responses to Prostate Tissue-Associated Antigens Occur Irrespective of the Stage of Prostate Cancer.

Figure 4A:
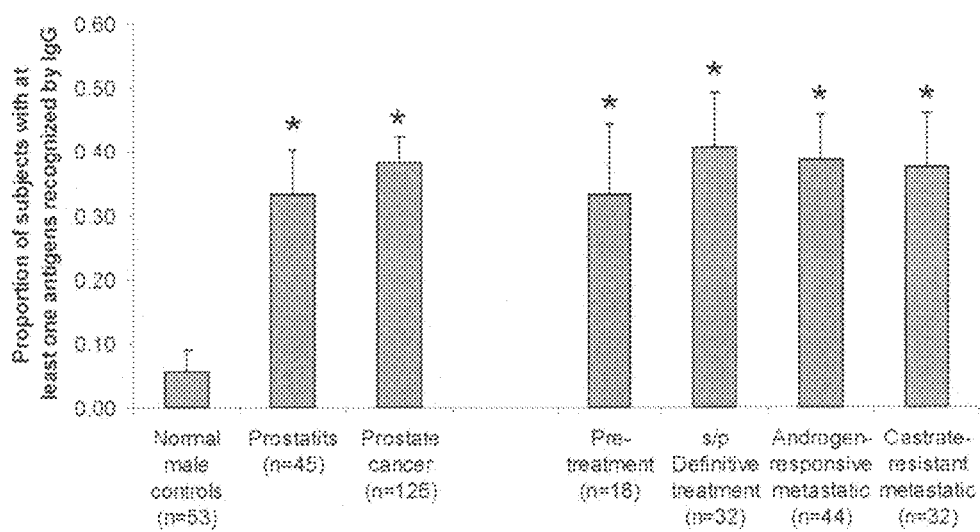
FIGS. 4A-4B illustrate the proportion and standard error of subjects in each population recognizing at least one (FIG. 4A) or at least three (FIG. 4B) of the antigens identified in Table II. Asterisks denote higher frequency compared to control population.
Figure 4B:
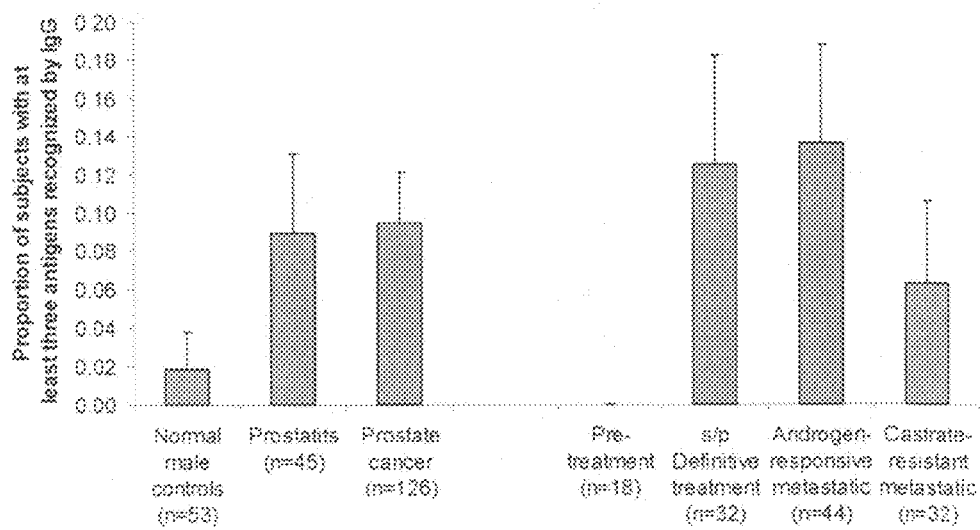

FIG. 4 shows the proportion and standard error of subjects in each population recognizing at least one (FIG. 4A) or at least three (FIG. 4B) of the antigens identified in Table II. Asterisks denote higher frequency compared to the control population (p<0.05, computed by logistic regression analysis and Dunnett's method for multiple comparisons). A subset analysis showed that the proportion of individuals with a detectable antibody response to at least one of the 23 antigens was significantly higher in the prostate cancer individual population when compared to the control population (FIG. 4A), that is, 48/126 (38%) versus 3/53 (6%) (p<0.001). Antibody responses detected in sera from prostatitis individuals (15/45, 33%) were significantly higher than those detected in the control population (p=0.003). Antibody responses detected in sera from prostatitis individuals were not significantly different from those detected in the prostate cancer individual population (FIG. 4A). As shown in FIG. 4B, the presence of immunoreactivity to three or more of the 23 antigens was more frequent in individuals with prostate cancer (12/126, 10%) and individuals with prostatitis (4/45, 9%) relative to male control blood donors (1/53, 2%).

Antibody Responses to Prostate-Associated Antigens are Uncommon in Sera from Male Individuals with Non Prostate Malignancies.

Figure 5:
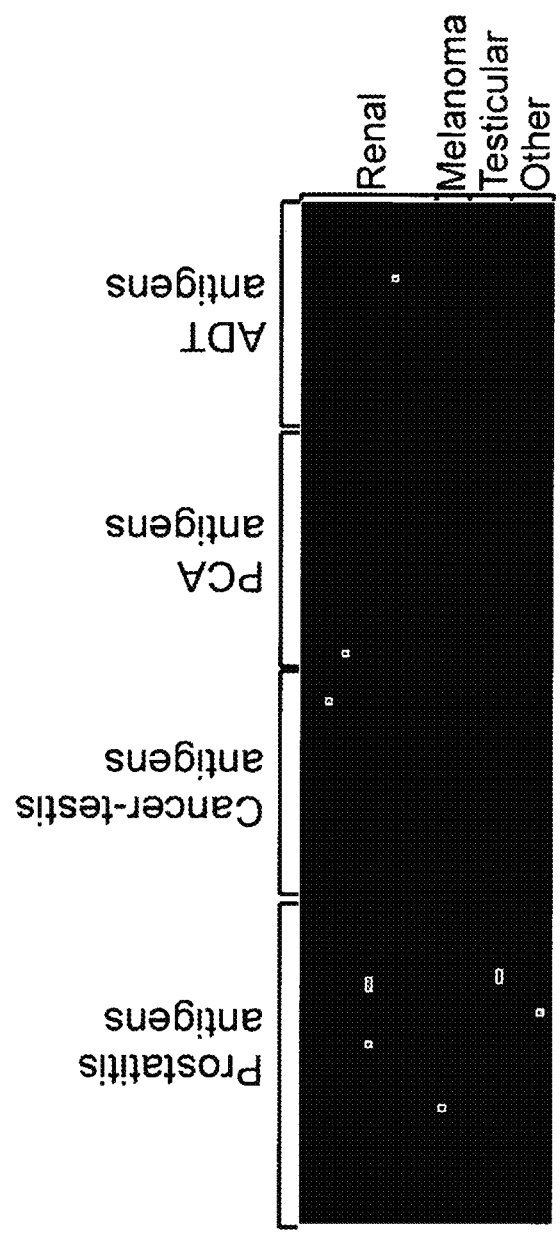
FIG. 5: shows a heatmap of the immunoreactivity for individual antigens among sera samples from male patients with non-prostate tumors. A white spot indicates a positive score.

The majority of antigens recognized by prostate cancer and prostatitis individuals are not prostate-specific in terms of expression, suggesting that the responses detected could be signatures of non-prostate-specific inflammatory conditions. To test this possibility, antibody responses to a panel of 126 antigens were evaluated using sera obtained from male individuals (n=31) with other non-prostate cancers (renal cell cancer, n=17; testicular cancer, n=5; melanoma, n=4; head and neck cancer, n=1; GI stromal tumor, n=1; bladder cancer, n=1; non-small cell lung cancer, n=1; carcinoid tumor n=1). FIG. 5 shows a heatmap depicting immunoreactivity for each antigen, grouped by the study from which they were originally identified, and for each individual tumor type. Spots were scored positive (white) if visually immunoreactive in at least 2 of 3 replicates. As shown in FIG. 5, while antibody responses were detectable to at least one of the 126 antigens in 7/31 sera samples (23%), only one response in 1/31 sera samples (3%) was detected to one of the 23 prioritized antigens. This result was not statistically different in frequency from responses identified in the non-cancer control population. The one response identified was to the Pro32 antigen, which exhibited the lowest positive likelihood ratio (Table II).

Discussion

Antigenic Targets of a Prostate-Associated Immune Response are Recognized in Populations of Individuals with Prostatitis and Prostate Cancer.

Immune responses to antigens originally identified in individuals with chronic prostatitis are also recognized in individuals with advanced prostate cancer relative to controls, suggesting that many "prostatitis antigens" represent true immunologically recognized antigens of the prostate, many of which coincide with antibody recognition in individuals with prostate cancer. Specific antibody responses to at least one member of a subset of 23 of these antigens were detectable in sera of individuals with prostate cancer or clinical prostatitis, but were rare in sera from male subjects with other types of cancer and in male subjects without prostate cancer or prostatitis.

These results, while not suggesting causality, suggest an association between chronic inflammatory conditions, such as prostatitis, and prostate cancer, or at least suggest that targets of a prostate-associated immune response can be recognized in these disorders. These results further suggest that the prostate expresses a set of antigens recognized immunologically by multiple individuals. The evaluation of antibody responses to prostate-associated antigens can potentially identify individuals in a premalignant inflammatory state at risk for developing prostate cancer. To further test this potential, sera obtained from individuals without a history of prostatitis but who developed prostate cancer within several years can be screened using the set of antigens identified herein.

Advantages of the phage immunoblot approach described here are the ease of transfection and protein expression in bacteria, particularly for novel proteins for which there are no available reagents, and the ability to simultaneously evaluate antibody responses to multiple antigens simultaneously from a single sample.

It is understood that certain adaptations of the invention described in this disclosure are a matter of routine optimization for those skilled in the art, and can be implemented without departing from the spirit of the invention, or the scope of the appended claims. All publications and patents mentioned in the above specification are herein incorporated by reference. Various modifications and variations of the described method and system of the invention will be apparent to those skilled in the art without departing from the scope and spirit of the invention. It is understood, however, that examples and embodiments of the present invention set forth above are illustrative and not intended to confine the invention. The invention embraces all modified forms of the examples and embodiments as come with the scope of the following claims.

---

SEQUENCE LISTING (129 sequences)

SEQ ID NO: 1 - DNA, 770 bp, Homo sapiens
cggagcagctctacccctcacgacgcagacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagagcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaaaaaaaaaaaaaaaaaaaaa

SEQ ID NO: 2 - DNA, 10302 bp, Homo sapiens
atggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcggcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagcgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcggggccgacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtga

SEQ ID NO: 3 - DNA, 3579 bp, Homo sapiens
agtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagc

SEQ ID NO: 4 - DNA, 3590 bp, Homo sapiens
cctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaa

SEQ ID NO: 5 - DNA, 169931 bp, Homo sapiens
gaattcttcttccccaaggcaggtcacagagaccagaacccctctccctcaaagcaagccataaaactaggcaggtcactctctcccttctgtcttgaagaccattccagaggggtaggaaggaacactgcagagagaggccaagaagaatctgagcagatagccttcctgggtcccctcggcctatcaccattagatcacaccctttgtccaatcgcatttctacaagcttgtgcactctttaccaagcctgagtataaaaacagatagctggctgagtgtggtggctcacgcctgtaatcccagcactttgggaggccgaggtgggtggatcacctgaggtcaggagttcgagactagcctggccaacacggcgaaactccatctctactaaaaatacaaaaaattagctaggcatggtggcgggcacctgtagtcccagctacttggtaggctgaggcaggagagttgcttgaacccaggaggtggagggtccagtgagccgagatcacgtcattgcactccagcctgggcaacagagtgagactctgtcaaaaaacaaacaaacaaacaggccaggcgtggtggctcatgcctgtaatcccagcactttgggaggcagaggggggcggatcacctgaggttgggagtttgagaccagcctgaccaacatggagaaaccccatctctactgaaaatacaaaattagccaggcatggtggtgcatgtctgtaatcccagctgctcggaaggctgaggcaggagaatcgcgtgaacccaggaggcagaggttgaggtgggccgagatcacgccactgcactccagcccgggcaacaagagcaaaattccgttttaaaataaataaataaatataattaaaataaacaaattctaacaaacaaaaaaccaaaaaaacaaaaaaacctctttccctggggtttggggtcttcatttctttctttttttaaagagatgggggtctcactatattggccttgctggtattgaattcctggactcatgtaatcctcctgtatcagcctcccaggtagctggggctaagggtcctcatttcttttcttttcttttcttttcttttttttttttagtgacggagtcttgctctgtccccgccctcaggctggagtacagtggcaccatctcagctcattgcaacctccgtctcccaggttcaagtgattctcctggcttagcctcccgagtagctgggattacaggcgcgtgccaccacgcccagctaatttttgtatttttagtagagacagggtttcactatgttggccaggttggtcttgaactcctgacctcagacgatccgcctgcctcggcctcccaaagtgctggtattacaggtgtgagccaccgtgcctcacctgagcgtcttcatttctgaaagctcccatgttgcgtaaaattttgattaaacacatttgttctgcttttttgttaccctgtgtctggttataggagtgtcagccatgacccttataatgagtgagggaaaagtaccacacagttctgccctacaatttttttttttagacggagtcttgctctgtcgcccggctggagtgcagtggcgcaatctcagctcaatgcaacctccatctcccagattcaagcggttctcttgcttcagcctcccgagtagctgggactacaggcacccgccatccatgcccggctaattttttttgtatttctattagagacggggtttcaccatgttggtcaggctggtctcaaatcctgacctcaagtggtccacctgcctcgacctccctaagtgccctacaaactatagtcccataccttactacaaccctatgagacaggtattattaataaccccgctttacaaatgagggaactgaggcaaaaagaacttaaatagatgggcaaggcctcccagcttgtaagacggagtcaggatctaaagtcagccagctctgaggctgatgctcctaaccgctatctgctgccctccttgtgagaaatcctgtctttggcttaggtcagttcaaagtgtttctatcatttacaaccagaaaagccttcagtgagactgtctcattttttcccaactcttccacttttcaaagaacccctccagggctccctcctgcagagaacaggactaggcagcactggcccagaagtggagcagtaagaaggtggggaacggggggagggagaggaggagaaggaggaagaggaagagggagaggaggaggaggaaggggagggggaggaggaggagtagcagtagtaggaggaggaggaagaggagggagaggaggaggaagaggaggggtaggaggaggaagaggaggggtaggaggaggaagaggaggaaggaggaggaagaggaggaggaagaggaggaagaagaggagaaaggaggagaagaaggaagaggatcaggaagaggaggaggaggaagaggaggaggaagagaaggaagaggaggaggaggaagaggagaagaaggaagaggaggaggaagagaaggaagaggaggaggaagagaaggaagaggaggaggaagagaagaaggaaaaggaggaagaggaggaggaggaagaggagcagaagaaggaagaggaggaggaagaggaagaagaggagaaggagaaagaagaggaggaggaagaggaagaggaggaggaagctggacttgacactgagacacacataccctaactcctccagtggctggaaccctgagaagtaacctgggagccatagctagccacattccctaccatgcggcagggggaagagcagtctgtgcagagggaacacagagggaggcagggtagagcagcgaggagggaaggagggacctctgcaccgtgcttatctatagttctagcaccttggtctaacttggctgcccgtgggcaccacaagacacctcgatatctgtagaacacattttcttccttgctggagccagcccgcctgggcttctgttatgtgcagcagaatcctaacccgcccagaaggctcaatggctgtgtgctgaatcaatgctttgcagtcctcccccgatccctgaagatggcaggagtgggatgtggcacagtcaagtgactatgagtgcaggtcagggcagcagcctctccagaccttcccagtgaggctgcccaggtcctggggcagaacgtgtttgaggggcttctcattaatctgtcaggaaagatgacgtgctgacctgcaggctgacctgggaggggtaccagcacccgacactgctctggctctcagccatcaggcagtgataccatctgccatcttcactccccaggcacctctgtaactgctccaggaccccgacaagcacagccctccactgccctccattcaaggctatccctccctcatccataaattcattcatacattcatcaaatgttgactgtccccctcattacactggacaccattccagatgcagagactgtgtgccggcttttctgtttcctcttgccccacagtccactctgcccttctctgctcagaaggctgggctctagagactgcatcactgggctctcttccccctggcttccacttgggttcagctaatgggagcaatggcagcaagaccagagggcaggaggagagacggatgggggagtttattctgattcccccacttcggcatgtgcagccgccggcctccaagacagccttgctgctctcggctcctggcatctgtgcccctgtgtaatgtccttccacattgtagcagggctggtctaagtgagcaacagaatcattagaaccaatagaatggtggaaatgatggtttgtgacttctgagactgggtcttaaaaggtattgtgggggttgggctcacacctgcaatcctagtgctttgggaggccaagggagggggattgcttgaggccaggagtttgagaccagccttggcaacatagtgagtgccccgtctctacaagaaaaaaaaaaacaaaaaattagctaggcatggtggtgcctgcctgcagtcccagctacttgggaaggtgaggtgggaggatcacttgagcctagtagttccaggctgcagaaagttatgatcacacctctgcactccagcctgggcatcagagtgggaccctgtctcaaaacaaacaaacaaacaaatacaaacaacaacaacaacaaaaaagcaaggccaggcatagtggctcacacctgtaatcccagcactttggaaggccaaggtgggtggatcacctgaggtcaggagtttgagaccaggctggccaacatggtgaaaccccgtctctactaaaaatacaaaacattagccagttgtggtggcaggtgcctgtaatcccaagctacttgggaggctgaggcaggagaaccgcttaaacccgggaggcagaggttgcagcgagtcgagattgcgccattgcactccagcctaggtgatacagcgagactctgtcaaaagaaagaaagaaagaaaagaaaggaaagaaagaaaggcattatggcttctatattatcacctgttgtgggataagccagctgccatgatgtgaggacactcaagcagtcccatggagaggctacagggcgagtgtgccgccttggaagtagacctgccaacttctttttttttttgagacggagtttcgctcttgttgcccaggctggagtgcaatggcgcgatctcagctcacggcaacctccgcctgccgggttccagtgattctcctgcctcagcctcccgagtagctgggattataggcatgcgccaccacgcccggctaattttgtatttttagtagagatggggtttctccatgttggtcaggctggtctcgaacttccaacctcagatgatccacctgcctcggcctcccaaagtgctcggtggcctcccaaaggtgtgagccaccgagactggcagacctgccaacttctgttaagccttctgacacctgcagccctgaccaatgtcttgagagacccaaagctaaactacctacttaagcggcccctgcaaacctgacctacagagactataacaataaatgtctgttgttttaagccactaagttttggggtagtttgctatatggcaatggataatgcagcgtggctctggaccaggtgttctcaccctgcctctggcaatacagcttgtcctcctgtgaaacaacttcctactactgctgtctttggatgtctcaatgtcccctgttgacttcctttatcctgtcctcaaccctttactaaactctcttcaaacttcacaatggaatatgttgcctgcttcctgcctggtgcaggttggaattatgaacaagacagacacccttcccttcagagtttatattctagtggggaaaacagacaataaattagccaacaaataaataagcaaggtaatttcagagaccagtaagtaaaacagagaaacgaatggaaaaataaatggggctcgagacaggctgatcaggagcctacactaggcaggcttgtcaacgaaggcctctcagaggccgtaggctcagtctgaactcaggagaaggcaactcagacagaagaggctggagcagtcaaagggagcagcgacgtccctaagataggagagggtgtggaggtgtcaggaacagaggagggaggcccacgtgctagagcagagctcgcagggtggcaagtgggagaggggagctcaagagactcaggcaaagccagatgaggagtttgggttttgtttaaactacagcacagcccctcactaaaggatgttcagtgaggtccgtgtagtatccaatttacctttggaacgagctctccggtcttgacacctctgcctataatctctagacccataacgtgggctgacatgaacttctcagatgcaaattgctctgaccaggatgtcctggtcagccctctggggtggatggaggggctgctcctaccaccagcctggggacctcccacccctgcctcatccagagagcctcgcttgccacatgggcacgaaaggggccttccaggtctctgggctttagcagggctcacccactctggctggctctgattttgttttgaggaaaacaaagtccaggtgttgaagtggtctgaggaaggttacaccatgcaatggactgaatgttggtatctccccagaattcacgtgttgaaacctaatccccagggtgatggtatttagaggtggggcctttgggaggtgattaggccaggggggtggagctctcacaatgggattcctgctcctttgcccatttcctgccatgtgaggacacaggaaggtgactgtctgtaacccagaaaaaggtccttgccagtcaccaaccaggctggcacccagatctcagacttccagccttcagaagtgtgagagataaatttctactgtttgtaagccacccagtctacgataatttgttacagccacctgaatggaccacaacaacccaggtatgcaccccctggccccgcctctacccagatggaaagggaagatcagaaggcaggagttcccgcccctcctcctggccttgcctggtcctgtctcacagggtctcacagtggcccttacccactccctggcctgcctctctctctgagagggtgggtccttctccccacacaggctgtccatgaggcaacctgtgaggggcaggttggggagggaggggagctcggctgctcccaccaggcccctcctcctgcccccatgggcactgaccacccagggaccaccggcctgtgtcccgcccggctctgggtcactgcataggcccaaatcacacctgtggttctcctcggaggtgtaaccttgctcagatcacttgattacctgaattttgttttccttaactcaaagatgggcatatacatagccctcctatttcttttttgcttttttgagagccccatcgcctttcaccctctcatctgtgagcaactccattgctgctctaggaaaggcagagtctggcacctggcaaggcctcctcacaggcctgactcccgtcccttcccacctccctaggcagaaccgggtggaactgcatgagaagcgacggaggcgccagccccagccagctccctgtggctcctggcaccaatcaggcctcgaggcttcctcaacaccagctttccttcccctcccattgggccctgcatccctgccttctgcaacattgtgctcctgaccctggctggctcccagccctccacagctgggccccacctcagagcctttgcatcaggtagccccagagtcagagagaaggcccccgacaaagccgcagatggagctcagccccaggaaacacctttccagagcaaggctccagctcactgtaggaccacagtcaagtctgtatccaggccgagcgacaggtgggcttgggaaccatctcactcccggcctagatcctacaccaaaaggaaaaacttccctcccacaccccttcgtcctgctctggtttcctgactgccagtggggaagcacttcttttggaagccactggaaattgagggatgagacagaaaaaaaccaaagcaacagagaagcgctcaagtgtggaaatgtccccagccggccctccccttcccgccaggtcgggctgcatagccctgggggagcctagacctggagctgcaggaacatggcagaacctcccatccaggcagggctgagctgcagatctggagcctggagagccatggagctttcccttccgagctcccagggccagtaggaagaagacatgagtgaaggggtgggtgtcaaaggacactcagcctcagaggtgaagacatctgggagtggtggggactgaggcaaagcggacagccccatgcagggccccggacggccttctatgacacctttgtgcaaataagaaaaagttcacctccagggagacaagggcttgcaccagggctcatggcttggtgggtagagagagggctggatttgaactttcccctgcctccccctaccccactacccctctgtacgcatgctttcgtgcaaggtacaacctgtacaactgtatgtggtggccttggccccatataacagggatggctacttagctccagccctgcagaaatgagggcttcatgttgctggagcttccagtttttcaagggcagctgaatacagggatcatgtgaaaaattctggtttttaaatgttggcaatgaattcaccccctgggccaaacaaaaccaatctgtgctagtggcaccaagggagagcacctcaagctcttggtgcctggaggacgggcttgtcctccttgggcctgtctgccagtcctccttgggcatacagctgctctgcccagaaaggcacccaccgcacaccccgggacctggctggctcggaccacagccaccctaccggcttgggacagtggatgtagcgtgccaggctgatgatgaggtcgtgtgtgatggggtccaccaggttccggaagctggcgtagcgatacagaacgtcgtctagcgaggtcgactccatgcccaggtcctgcaagagcaaaggatgcccagaggtcagggctggctgcccacccagctcgcccaccatccccaagagaagtaggcacagacccctagaggcgactctgcctcccagagccccggtggggagcatctgcagaacttccctcaggggctggggcaggcctctcctgtttgtctttgcctccaagttgaggaagagcagggactggcctctgcaggctctgcagtttgtgcaggtcctggcttgtggccctctcctaggacagcccctgacctttgtctctctggttttccagaggaggaagccaagggtggcctgcctcggtgcaagcagctgcttctctatggtggcaaaatttggaattaactgccttgtgacaggatggtttaatgatatttatttgtgttttcttcctgcttctgacgttgtttttactgctccttctgtagccgatgcagcctcagtgttcctttgccttgggggtttctgagtggtggggttgtaagcagatcctgccaggcacccagaaggaaacctcatcaggactccctcagaaaggtactgagtggaatcttcccgatgggaggggagcagcttggaggcgagtgctactaagtgtggtggggccgcggcagaaaccgctggagcagagcttccctgggtctgaggaaggaattgggtttgggggctcaggacacaccaccccagaatatggtaccctggcatctgaggaggcagctgacacaggaaggtctctctgactgctgttctcccccaaagcaggccctgaagaatcctgtgaccttcatctaaagtaggtcatgagacccctgagcttaaaacggagtgatcggctttggagaagtaaggagacatgacgtgcctgccctggggtggggactaaacttcgtgccactccacgtgaaagggggaggtacgcctgctccctttcctcaagcccccccctcccaatttctgccatccttgggtatgagctacacgacagtccctgaccctagcttggtgccctgcacagaccaggcaatgctgacattcccatccggagactgtcctcacaccatcctggggaacatgagacatccctgggtagggaggcaaagcaggcccacccactgcaggctgtcctcattctgggggctcccacagctgccccagcacagcccagagaaaggctcccagcccaggtggctggggtccagtgccctggggacgggacgtctgggcagggaatgtgtgggtaaccagctgagtttgctccttgtcattttgtttgtattctgaacttttaaaataccttccccacatgattcttagaaatccctggaaggcacgcaggctggacatcatcatatattctctacagatggagacaccaaggcccacgccttctgtgctgttggaatttcaggaaggatgggggtggggcacggcctcagccctgggcatgttctgcagattgcactgctcttatctgccagggggtggtgagagggtggctgagctggacagatggcgggcagggacgggctctgcggtctggcagctgacattgatacaagcaaaaaaagagtctttgctgggggctctggagggcctgggtgtcatgcctgggggtgggaggagcctcttgtggggagccccttggagcccaactgccagccaggtcctacctgccgtggttagggggcactctgcccccaccctcattaacgcctcagtgaggacacaagaggccagttgtgagggctgttttccatatggcaggaatgaaccttggaggcgaactgccaggtcctgtgccaggctctctggctgctgaaaaaatttgctgggaaccaggacctgggggctcaaggtctgtcatggatgcagtcaggggaggcttctgaagcactggctggtacaggttctagagctgcacccccttgtagaagcaggtacaatacccgcctttgacctctggccctgccctggctttttcaatccctcagccagggctgcatcctgaagcaagcaacctgacaatgctaagcctcagtttcctcatctgtaaaacggggacagtgaccccagcatcacaaggaggcaaggggaacaagaccaagtgttacatgtaaagcctctggcagggaacagagaaagcagcagtgccctttctactacatttctgccccctcctccctggaaggcccgtcctcaccttctgcaggggttctcgatctcctggaccacagacccaattgagaatgtgtcaaaagccatgagctctctccctagaaaaattctggagtcagggctgggcggggacctgagcacacagagtccacactggcctcatggtcaggagggtgtgtcagagccgtgtggacacgagggaccccgggacacaaactatcacccactaatgtgcaaaatcacagccctgcctccctgaggcgggaggaagctggggacacaggaaggccgaaagtcaaaggacttgtgttctacggtctcagagggcctgtgtggtcaaacgagctgtggcccagtgcctggtttgccagccagtccctgcctacagcttgaggctccccttcctggggacagggagctggagaaggagggcagatgaggtggaaacagaggggtggttattcccatggtcagaggctgcactggtggccacggggaggaggccagaggcatggagctatttttcttttacactcggtcgagcaggctgggctgctcctctgtggttggcaacttaatgccagcctctatgcctcctctgctttgcccctgggcacccctctcctctgtgagcacccctggcacctagtggtctcccccttacaattgtccctgcagtctgtccctaaatgaccctgggaaatagcactggattttaggccctggccagccccaactcgctgtaagtctgtggcaagagacttccctcttgggattcatttccctatctgtgaaatgggcagatgaaccacactagtggttattaaactgtgttccaagatcttgaggctgacggtcaggggctgcggtagacgagagaggtgagaggaaccagcagggctgtgggctgcagctcttacaaagcagctcctggttacaaacaaatgaacgcagttctgttccaaagaaaagcttgaaagccctggaccagatgactgcctgggtttcttgtgttcctaccagccctgccccatcttcctggaccccctacatctccaagctagtctaggccatccctggaaggaccaagaaaatcccagttgccaacccaggaggttgggcaggtctgtgaagatgccaaatgtcctttccggagcccactcccctgccgtctccccgcgccatccccctggttgcccagctgctgactgtggctctgcctctctggagcactgtctgggttcatgtggttgttgcttaggaggggaaaaggagtgtagaggcaggatgggagggaaggaggagggtctcctagaaaggcagctcagggtcactgtgagtcacggccaacaccggcccgccctgtgaattccagctggggtggggctccccaaggtcccagggctacaacagggaaagccagatagaggctggccaaaggccatggcacacattattgctttattgctttatttcaaccccacctaggcccacaggatgcttgtgctaactgagggcacttcatagtcctgaggaccttgggctacttcctgcctccttgatgtcctctccatcccccctcccctaagccaggctattggagatgatggtgtcaccagctgctgggactacccacagggctgggtgtgagggaggagaggtcaccagatcctcaggtgtctcaggaggctgcagcctgggccacagccctgggaatgggctcctttcagactcggcacccatggcctgccctccttctcaggaagacacagaatgggggtaggcacacaaggcctgctgcatgtgcaagggaagtggaagaatcagatccaggtgtggtccctgcagcccctcctgtgcactgtactagtcttggaggggctggtttgtcttaaaaagcacaaggcattgaggacaatcccattttcctcatgataggtctaaacggtaccacctctaggaactgtgcctgtggacagttcctcatcaggatgtctgggaacaccagcaggtgcacctgagtcactgctggtggggagtgacgctcggagagtgtggctggcctgacaccgagtcactcttggctccctttccgagctgccggacccagcacacagcagcacacggcattttaaagaagggggccctacataactggagcttggataaacaggtctggggactcgctgcaatgggaagagatgatgggcttgggaataggggtgcatgtttccaaaaagtgagtagagatttacacagggcagtcagaatggcatttctcaaagtgtggtctgtagactttggggaagcacccttaagaccattttaggggtgctgtggggacctcttttccaatgacatatctatgtgatgccagattttcttcatagatgtcaattaaaacaacctgtcgcaagacccagtgcaaaagcgcaagtctgatagccgtcttctagaaagtgagactaaagagagtcacaaaaatggggagcaacaccactctcctcacttggtttttcttttcctttggaaaatatagttattttcataaaaatttattttttcacttgtgaacttgttattttttattttgagacaaggtcttgctctgtcacccaggctggattgcagcggtgcgatcatagctcgctgcaaccttgaactcctgggctcaagtgatgctcctgtctcagcctccagagtagctgggactacaagcgtgaggcactgtaaggagctgctgttattttttttagatgtgaaaacaaccctatgaatgtaacagctggcattttgcattcacgtgtgtgcaaggtaatggcatggagtgtacatgatcactgccactcactcgttgatgcctccccacagttggactcgcaccttcactctgtattcctgtgcagtagggaagtcacccagtacatgtttccccccaggaggaatacacagatgctttctcttctgagctctggcctccctgagaattccttcatgttgatgacacacctgaagacaacctggctcaacagaaactccctgcaaaatatcgcagacttggctaccctctgactttcagtcctgcagatgagaatgaggctatctgatttttgtttctttagctgcttgttcggccctggcgcctgtagggctgtccttgccacaaaaccccactgtgcctactggacagccctagcacactgtcctcttcctgggaatatcagttcagcatataggaggcctctgaagcaactgatatctctacagcaacttctccaagtcaccaaagggacatctcattcttgacatcgcccaaactcctaaaatcccttccctgtatctttcttactactccaacatcccccactttctcatttccaccctgaaaacccagccaaaatctttctaatacaaataaacttaacttctctggccaatccagttctcagatccaaaaagccccgtaaaatcccagaaaataacaagggttggcaagaatgtgaagaaactggaaactttgtgcgctgctggtaggaatgcaaaatggtgcagccaccatggaaaatggtgtggcagttccttaaacaaattaaacacagaattgccatatgatccagcaattccactcttgggaatatataccccaaagaactgaaagcaggcactcaaacagcagctatgtttccagcagcatcattcacagtagccaaaaggcgaaaacaatccgggtggccatgaacagatgaatgggtacacggagtgtggtctagccacgcaacgaaatattattcagccttaaaaaggaaggggattccaacacatgctacagcatggtgaaccttgaggacacagggacaaataagtgaaataagccagacacaaaaggacaaatactgtctggtttcacttatatgaggtatgtagactagttaattcatacagacagaaagtagaatggtgggtactaccaggggctggggggaagggaaggaggagttactgtttaatgaggacacagtgtccgttttgcaagatgagagttctggagatcagctgcacagtaaacagtgtgaatgtacttaacaccactgagctgtatgcttaaagatggttgagatagtaaattttatgttatgtgtattttaccacaaattttaaaaggggccaggcccggtggctcatgcctgtaatcccggcactttgggaggctgaagcaggaggacagcttgagccagggaggttgaggctgaagtgggctatgacggtgccactgcactccaacctgggtgacagagccagacccccaggcaggcaaacatagacaccttcttgggataggagggggcaggggagggtgcacattctatctggccattctttttctacccctgacacttggttattaaacatttttgccaccatgtgtctagtggcggatctgtttcctttggatttactttcaggtattggtctgcaaacacagaccttttttcaagctgtctcttcctcaggaaaaccaacactggctctgtgtcttctggatttatcttttttggtattctgtgcatgatacactttcatccagggtttccagtttgccttccatgtcactgatttcacatccagcatcaccgctctcactgcccccaagaaggattgtaagtcgcctagcatttcatttccttgcaattcttattttgcttgttaatctcccctttcatctcatcctgttggttttcttttccatcacagcttggcctctttgggtggccttttgttcttttcccacaaagttcatttcttctggatcgtgctgtagatcattttcagaggtcggggttcaggttccagggtatctatcctacgctcaggcttcccccctccccagcttgtgcactctcaaagaggccaagatctagtgacacccacgtctatcagcgcatccttgtccccatgacggcctccttgggttgggactgagtccacctctcagggctctggcttgcagaagagtccagccccaggatgagtctcaggcactgtgcttatgtgactctgaccttgagaagggacatcttcacccacttcatggcctgaatctccaacactcacaacagtgaagtccatggaaatctataacaatgtctgtatgttcaggacacttcctgtccttgggtaagcccactggctggctgcactggacttctcagatgccatctcttcccgccttgggagttgctgtctctgaaccgatgcagacagaggcatgggagaggatgaagggagaggggagtggaagagccctccttttacctccaaattgtcacttgcgtggtacaggaccagttgcctggctttctgattggcacagtccacagactaagggagaaagtggcttcctcccttccttccggaggtctcagattcctgggaggaaggctgcattgtgtctttcttggccctgctccatgtgtctagcagtgaggaggctcctctcagactgcccacctgtctttgtttccagtgtgctgagtgtttgtctttttttggtgcatcgtcttaggtgtcttaggggaaagctaggggaagccacagaggaggccgtcagccatactctattttaaacctcaactccccccttccctcttaaactcatttttaaccccactcccagaaggaaggccccgcgggaaattagctttcatttgtctctctcctccaggcatgactccacagtttctgcaacaacagagccggggaaaggaggacgcagcaagcgctgaatattaaccagcaaaggtagatgcttcaatatcgaaaccaccgggacccgcatgtgcaaagctacttaatgagggtgtaatcaaacacagtctaccagaaggaaattaattagagtccggagagcaagcaggaagcagaaccaggctgctccccctcctggctctagaacatcactggcagccactgctaagggagggacaaggctgggggatgccaggcctcagctgggtgccagggctcctgtcctcttccccgtgacattccggcttgcctttgggggacacccaggggagggaagggaaatgtcaggtgctgttagggaaacacagcctgaggaagcccccagggagagaagctgggacatcccagagttaaggagctgggcacagagaagacttgcttctctaggaagacaatggtctcataagaagaaggacggaatcataaacaacagaaatgtattctctcatagttttggagaccagaaatctgaaatcagggtgttggcagagctgcactccctctagagattctagggggagacttcattctttccccatgtgcgacaaggaagggagggatgccaggcacagacctatgcacctaatgagagaaacagatacaggatgcagtgggatgaatggtggcccccaaaagacatgcccatgcgcttgtgcccagaaactgtgaatgtgacctcatttggaaaaagggtcttcacacacagattaccttcaggaccctgagatgagatgatcctggtttatccaggtgggccctgaatccaaaacaagtgttcttacaagagacacagagaaggcagcaatgtgaaggtggaggcagagaagggagtgatgcggccacaaccaccagaagctggaagggagaaagagtgaaatctcccctggaatctctggatggacacggccctgccgacactctcatctcagacttctggcctccaaaccatgagagaatatgtttcggttggtccaagtcactcagccagtggtcattggttacggcagccccaggaaatgaatgcaccagattggatcaggacagaggtggcatttttcccaggggcacaccaggcaaaagggagaagagatcaaggcaagtggccgggacccctcccttcttccacagctgcagacctcagccaagagcacagctgtgggcaaccaaggacgttattgccagaaatcaacttgctgtctccaccagccctgaagcctctgtgggtacactctcctttgctgtctgctcccaggggcagggctgtactagtcagaaatgcttcctataggatccccaaggtggttctcagctcaacatgggaaagaacctttaaaaacaggtgatgaaggaaatgctgacactgtccacgacaaggatgaggcttgaagactccactaagagaaataagctcggaacgagaggacaaataccgcatgaggccacttacgtgagggaccaagagtatctaatcattcaaagtactcaaattcacagagacagagggtaaaatggcagttgctgggactggggaagggggaattcgtgttgggtggggacagggtttcagtttgaggaagatgaaagagttctggagatggaaggtggtaatggttgcacagcaatatgaatgtgcttaatgccactgaactgtgcacctaaaatggttaaaacggtattttatatttgtatattttatcgtaataaaaaaatagtgctgagctcactgtcactggaaggatacaagcagaggagagacactcatcagccggcactgctgaggcaggatttctggaccacaaggaaggtggccactaagggttgccctctggccccctgtgactcttctcatcagcatggcccaggatgcagcatcctggcatccaaggaggtgccactaagtagctacaagatgtggggcctggcgagaggaaccacaaaagaacgcagaaaaaaaaagcaacaaaaagccagtgacaaagctgcgtggatggcggaaggcgagcaggagtttggtgatgcagtttgaagaccgggactgagacccccccactggaggggtacgtggggtgcaaaagcagaagtggcaccagtgggcttgactgctccagagaggggcattgctcctcagtgcagcaacaaggcgcctttagcccccttgtcgtttttggccccaaaagtgccacagttacacagggtggccctggagcaaagtgagtgctaatgcgctggggcatacggaaatctggtatttcacacatttgtcatgttaaggagaattaggcgtatcagagtatctaacagattggccttccaatccccatttaaaacgggtaattgagtagctgattttaagcttatgattttaagcagaacaccggaagtggattcagccaagtttgtaagttttgaaatgtttcagagaactaatagtcatcatatttatcagcttattaaatttcaagaactatttaggaacccaggaaagtcctgctttttaggatgagtatttataaacttaagaacactggttatgttaaatttataaagttacatcaagatatttaaagaaatttaattacttaagttataaaccccctacccttgaacatcgacatttaaatggactagattcgtgaggggaataatgaaattggtatgttaaatgcttcaggaaacactaggtttaaaaatttccacttcaatatatattgaatattgagaaaattcaagtcgttgtaagtagtctgtgtgtgtgtgtgtgtgtgtgcgcgcgcgccccaagaataactaatgacagataatgcagatgaggtgggcaccctgcagagtccagggcagggagcatcagcacagctagacagggaggactatgcagttaagagcccgaggcacactgctcaggcttggaagacaccaaagcaaagcagactagcaaaagtaataaaagcaactgctacatcccctccccctaacaaaaccactggacggcatgggaaccctgtttgaaggtgaggcctcctcacagtcctgctgatgtctaaggtgggcattgcccggctcctggtcccagtcttgggggttgcctctcgagggcaccctggcttggtgcccgccacccccacaggcctgtgagtttggtacccaaggaggtgtccattagcacccagctgaccgaagtcagccagatgctgccagggagggctgctctgcagaggtctgagccaagaaactgctggtggggggtcattggcacccactccccgctccaccagacttgcccagcctgtctgagggatgagaggtaaagactggggttctctggtcccacctgagggtccaggggcagctcatgactctcccacctgtccaaggccacgtggcccctgcaggtttttgaagccaggcaccccggcaggctggccctcctcgacggtgacgagtgttgccaccaggtctgccttgcccagcaggagtcagcgggctgggcagcgatgtttggcagctttgctcagtgaggggcttcatgactgtgtgttgtttgtgttttaactttgaagtcttaaaaaatgacaccctctgtgtgaaacaggcctctggaaacagatgcccagccgttgccaagtgtaacttaattaaaatccgagaaacggctttagcaacaaataaatatcaaaaggatgctttctcttcagaataatctaaagtaagttgggaggcgcatcaagccatatgaagggttttgtctgctcctccatggtcatggctctgcccacacgtggctgacggtgggggacagacgtgggttagatcctaagtcactgtgtggccctgggcaagccaccctcctacaccacagcttccccacctacaaatgagaaggttgcaccagctcattcttccagagttggagagggcagcagaagagggacttggaccaaataggtttggaacacaaagaattcaacaaataaccattttccttttcctgctggacgtttcagctactgttttatgactccgaaagggtggtggcatttgcagtatttcccagatttatttcccaagcacctcccctgcttccccaggacctcttgtgggactcagattctgcagtatgcctggggccagatggtctctgaggtccacaggcccctacattccacaaattctcagcactttgtcacccatcccagcgccctcctaatctctctgcttgggaaattatctgaatcggttgtttataccttctggcaaatgcattcaagtccatttgtccctctctgcagtacattctgcccaagtgaaatgaaacatttggttcatcctgaggccgggcgcggtggctcacgcctgtaatcctagcactttgggaggccgaggcaggtggatcacgaggtcaggagatgagaccatcctggctaacatggtgaaaccccgtctctattgaaagtacaaaaaattagccgggcgtggtggtgggcgcctgtagtcccagctactcgggaggctgaggcaggagaatggcgtgaacccaggaggcggagcttgcagtgagccaagattgtgccaccgctgcactccagcctgggcaacggtgcaagactccgtctcaaaaaaaaaaaaaaaagagagaaacatttggttcatcctcaaaggattttcaggtaaaatggcaaagaggtagaggaacgacttagaggatccttctggctccctaacaacctgagttccaagcaggagtgtcttcataggaacagcccatttctcagagtgaaaagctgggggctggaaggttgtctcatacagtgagctagtggcagggatggggcgctccagagcccctagaaatttctgactctgcctctatgagcccttggaagttaagtattagccagggttctctcgagacacagaactgataagatgtgtgtgtgtgtggagagagaggaaggaattgatttattttaaggaattggctcacatgattgtgggggctggcgagtctgaaatctgcagggcaggctgggaagctggggacccaggaaggagctggcagtgctgtctggagtctgaaggcagaatttcttcttcctcagggacctctcttttctcttggagccttcaactgattgaatgaggctcacccatattatggaaagtaatcagcttttatccatttatgcttttgagacagagtctctctgtcacccaggctacagtgtggtggtgtgatcctagctcactgcagcctggaacttctgtactcctgtagtcccgctatttgggaggctgatcctcctgcctcagccccctgaatagctgagactacaggtacgtgctaccacaccagctaattaaaaaaaaaaattttgtagaaacgggctgagcacggtgattcacgactataatcccagcactttgggaggctgaggtgggcggatcacctgaggtccagagtttgagaccggcctggtcaacatggtgaaactccctctctactaaaaatataaaaattagctgggtgttggccgggcatggtggctcatgcctgtaatcccagcactttgggagaccgaggtgggtggatcatgaggtcaggagatctagaccatcctggctaacatggtgaaaccccatctctactaaaaaataaaataaaaattagctgggtgtgatggcaggtgcctatagtcccagctacttgggaggctgaggcaggagaatggcatgaatccgggaggcggagcttgcagtgagctgagattgcaccactgcactccagcctgggcaaagagcaagactccatctcaaaataataataataataataaaaattagctgggtgtggtggcacatgcctgtaatcccagctacttgggaggctgaggcagaagaatcacttgaacccgggaggtggaggttgcagtgagttgaggttgcaccactgcactccagcctgggtgatggagtgagactctgtctcaaaaaaaaaaatttttttttttttgtagaaatggagtcttgctttgtttgcctaggctggtcttgaactcctggcatcaagcaatcctcccgctgtggcctcccaaagggctgagattacaggagtgagccactgcacctggctttatttggcttttgtttttactcaaagtctactgatttcacatgtaggtatttcagatttcttttttttttgaggctgaatttcactctgtcacccaggctggagtgcagtggcgtgacctcggctcactgcaacctctgcctccccaagttcaagcaattctcctacctcagtctttcgagtagctgagattacaggtgcccgtcaccatgcctggctgattttttttttttttttttttttttgagacagagtcttgctctatcacccagcctggagtgcagtagcacaatctcggctcactgcaagctccgcctcccgggttcacgccattctcctgcctcagcctcccaagtagctgggaccacaggcgcccaccaccacgcctggctaattttttgtatttttagtagagacggggtttcaccgtgttagccaggatggtctcgatctcctgaccttgtgatccgcccgccttggcctcccaaagtgctgggattacaggcgtgagccactgcgcccggccatgcctggctgatttttgtagttttagtagagaccgggggttttaccatgttgggcaggctggcctcaaactcctgagctcaagtgatctacccgcctgggcttcccgaagttctgggattacaggcataagccaccatgcctagcctcagatgttaatcacatctgaaaaataccttcacagcagcatctagactagtgtttgacccaaaattgggcaccacaacctagctaggctgacacataaaattaaccatcacaagctaagcgtcttcaccactttaaatctctaggtcagaggcaaggccaaggccaaggccagacctccaagaatctggattcagacctcttgctgccctccctctgggtgagcagagatgagtcatgctggatgaggaatccagctccaatccagctagctttcaacttcaggcaggaaggggagaccaggcgggatagaggaggagggccgtaggatccacaactgtggccaggatgaggccctgcctgtgctcttccacctctccacgcttggccactttccccaagacctttcaaaaatgtgctctgggcagtggggagggcagaagccggcccaggaagggagccacagatgcccttccaggggccttcccagcaggagccaggaggaacaccaaggggctgccagactgccagacccctgcagccaggcagaatagttcccatcttagggccctgcttctcagggcctgattctccccgcaaaggtggaaaatcagcgaggcttccgggctgcagaagagggcatggggtgggggtggcgtcctcagggctgggaggggcctatacctggtttctcagtggtcactgagtttgtctacagcttcgagacaccgggagggaggaggtaggagctgtgggtgggagtggcggtgggtgaggcaagacagccaatgcaatgggtcaggcaaaggccctgagcttcctgcagcatctcaggcctctctctccatccagcgtccctgctctcaccctgagggtctctctcggtggactccctccctcagagcatggcccaggtagagacttagagcattttgctgcatacctgctctcaggtccccaaccagctgcccacactccacctcttgcccattttcttctttttttttcttttttttttttttgagatggagtcttgctttgtcacccaggttggagtgcagtggcgtcatctcggctcactgcaaccttcgcctcccaagtttaagcgattctcctgcctcagcctcccaagtagttgggattaggcacacactaccacgctcagctaatttttgtatttttagtagagatgggatttaactatgttggtcaggctgaacttgaactcctgactacaggtgatctgcctgcctcagcttcccaaagtgctgggattacaggagtgagccgctgtgcctggcctcccattttctaaaagagtctaattccagtccaaagtccctccctgctccgtgtgcccattaccttcagagagccctcttctggtcctggctcatggactggcctctccctaagacatgcgacaccaaagccatttctattcgcctcgccctgctggaccttttctggagagatgggaattcttggaacaggtaacttactctctttcgtgtctgagtttccatgtcccaaaccaacccctctgagttcctgctggtctgtcttgggccaatagctgtctggaaaccccaccagtgagaatcctgcctaagactgtttttactccgaaacgccacaatgccagaaggctgtggaaaacataagtctgcagctgagaatcataaaaagttcagaggactggcacgtcctaggaaaaactaaatcgactggagtgactaagcctgaagaagtggaagttacttaccggggtgggagcactcagacctcattcccccagaactgctagaggcaaggatatgaacagtctgggaagcttgaggggaatcctggacccctgcaatactgcagggtccggggctcatggaagcccaacaaggaaaccctgatgcctccgctggtgccctcggtgcccctgactgggtgagtccagatccactcaggttgtcttagattctgtctgatcctctttgagagccagagacaaggagtggcctgtgcagggtcatacaggactggtagctggaactttctagaagattcccaattgcttcagctcctcgattcaagagaaagagggcaagtacccgcctgagaggcacagtgttccacagttcattgcctcaggtgatttgagaaggctgtgcccaagaagatgcatgggagaagggctaaagctcattaaaggcctcagctgatactctaaacttctgtgtggtctcaccaaggctgccaagtacagctgtgcagggcatgtactgcacaagggtgtctgagcggggctgaactcaccaagccttgactctggctgtgcccaaccagacaggcaccttcttccacttctcataaaggcactctatgggctagaagccacattccacctcagtgaaggaaaccaaggggataggcatccttgagtgacctgactcagtcactgaatggcctctacacccccaagtccttggttttcctgggctgccagcagcagagctgtagcgaaaatctaacatggaggcagcgagctcatgaagcttgcccctcgctgggaacacctcttcaggtcatggtcctgctctctgcttcctccaacactaggtcatcattgtcatgaccaccaccatctcaacatcttactttaagaaataaactgttgaaaaagtgtcatttggagcaggggtcccaaacccccaagccacagaccagtaccagtctgtgacctgttaggaagcaggctgcacagcaggacgtgaacagtgggccagtgttcccacctgagctccgcctcctgtcagatcagtggcagcattaggctctcataggagcacaaaccctattgtaacctgcacacgtgagggatctaggttgcacacttatgagaatctaatgcctgatgatttctccctgtctcctgtcaccccagatgggaccgtctagttgcaggaaaagaagctcagcgccctcactgattccacattatggggagttgtataattatttcattatattacaatgcggtaataacagaaataaagtacacaataagtgtaatgtgtttaaatcatctcaaaaccatcccccaccccgggccatggaaaaactgtcttccaggaaactggtccctggtgccaaaaagattggagaccgctgcccgggcacggtggctcatgcctgtaatcctagcactttgggaggccgaggtgggcggaatgcctgagctcaggagttcgagaccagcctgagcaacacggtgaaaccccatatctactaaaatacaaaaattagccgggcatggtggcatgcgcctgtaatcccagctactcgggaggctgagacaggagaatcacttgaacccaggaggtggaggttgcagtgagctgagattgcaccactgcactctagcctgggcaacaagagcgagacttcgtctcaaaaaaaaaaaaacaaaaaaaaaaaactggagaccactgacagggaatacactcaaggtaactatgctccccattcttcccctctcctgaggctgtccctccccatctccttctcctgctacagggaaggggcagcacaggtcctctgtgccccagagcccctcttctaccctgcctgtgacgagggaagtcaggccacctgtcccaacctgaggaagctcagaaaacaccaagtttttcactgggacagacccaggcatcacttccagtacttctccagggaccactgggctgggcagggtcttgggaattggggacctggtcccagtcctgtgtgaccctgcacaggccactccttgtctctgggctgtgtgcgcctctgtcaaacatctcagctctgactgcagcaggtcttctcaccaaaggagccgtggaacccctcctgctgccatttcctccagtgagggagaggggcagaggcagatccaggccccttggccttctaaggacattagagcctcagcgctgcctgtcctctgatggcagcgagccaggaccattgccaggagagagccggtaagaacacaatgtgcaaggcagccaggtagcctattacaaggccacaggactacaccaggtaccagcacctacctggtgccaggtgagatgagagcccctccatgcttccctctctgtggcccctgctctctcctgcccgctcacaggaagtgtgatagtcaactgtaggtgtttatacatgtaaatctccttttgagtctgtttctgtggagaaccctaatacaggaagtaacatccctacgggaagacattaagagccttaagcagcaaattatgaaccaatttcaggagcatctctctgtcatgctgagtccactgtaggcccttccataggaatgcagagcttcaatcttccacacctgggccccggcaggtgcactgcaggaggattcactggctaccccctgcctcccccatgatggcctggcaggagaaggtgtctgtgggtcggcaagatggccctggcattcagcacaggaggggagacatgtctcctccccgagccctgtctgtgcttgtcctcatcctgcatctgagctacaggccctccagacagtggggcaggcagctccaggctgaccatttaccatgaggaaatcagaaacagaggttttgtttccagctgcccagcccaccacagagccctgcctccccaggagcacctgcagctcctgttcccctgattcccccaccatctacaatacagccctttccatagtccgcatacgcagaggactccccaggtccccatggggaaaggggtgttgggggtactgccaggtgcgcggtgtctactgggcggtctaggtccagggcaggaattctgactgttacgcttggtgtggggcaggacctcctgggcccttacctgcccccggtgccaatggagagaaacctgccccactcctgcccctttctattgggtagggcctgaacctggggctccaggaggctgtgactgcatagacagaaactaagggcagtggggtgggatggggggcatcacaggttgccgacttcccaggctgcaagtgctggctccctgtggtgctgggtgtccttcagtggacgagggtgtcctgcaagcctccttggcacctgtatctgtgggtggaggctccatggggacagcggctatggggtgggaatgtgcctggagggggcactgcagggggttccgagatagctgggggctcttcccacaggtccctggcatgctctgggagagacctgggctgagggccgtgggaaggccaagtgggcaggagagggacaggcttgaggaccagggccgctgggaggcaccagcagagcaggtcaggcaagcccacctaggaagtgggggagacggggcttcccacaggtcctgggcctagcgcctgtgtccactcatgagccccactgaggaaaggggtttgcccagcagccagtgtgtgccgtgccctgcacctgtgtaggcccccatggccagagacaagggcagagctggaatctgaccatggccagccctgcagtcacttgccagtcctctatggcatcagcgactgccctgagcccttctagaaattagcatcttggccggccctgctttccctacttgtcccaactggtgccagctccacttaggtgcccagggacgtatgctgagtgaaagaaccaagtactagtgcacagtcaggtgccaggcagggttcttgccctctgaaggcaaaggtcctgaagctcggctggggctggcaggtctgggtctctgtggacaggacagaggctggagtggggacaggctccatccagacgagcatggagagcagcccctcagagaaggaagccagagtgggaagtagagggaggggagagagaccagatgtgcaaggggccagagcagccccacagtaggcagaaaggtggcaagggagccaggcactgagtcatgtggacagcaggtcccagcagagcctgccccagcctcattaccctccccagtgctctgagatgaatggtttgtggcacacagggcagctcgggcctctgtgagggctgggctttgctcatgtgtgaaagtctgcaggttccctggttctggcctctgcccctggcaccatgtgatgtggcctttcaccctccgtcagctaggactgcggtcagcacagacaggttggcctcggcagtatgggggtcggccccagtacctggtggggaggtatctgtcccctctctgtcctgggaccgctgcatcccagctcttgcaccagctgaggccaaggtgggtgaccttagggttcgaatgtgaatctggctcagggcctggaagaaataactgaccacacatgggaatgaatgggtctttccaaaaccacaggcacctggtggaatctcagcagtggtagggaaactcaggggtcatttcgcccaccactccttcattctggaactggggaaactgaggccaaagaagggaaagggctgggcaagttagggtttccactggggccagaactgagggctcctggctcccagtgaagccagcctcccttctgtgccacgctgcgcacctgtactggtggtggcttctggggtccttgccatccctcccggaggaagggaaacagctgctgccatggttttctcctggtgggttgcctgttgcatccccagttcctagactggtgcctggaggaacaggaactcgattgttgaataaatgatttaatgcatactacttttttaattttctgctcatctaattttctcatttttctataattgtatattgcttttataatattttaaaaaccaccatttttactttaagcaacattgtgtcaacttcacaaaaccacctaatgaggccgggtacagtggctcacgcttgtaatcccagcactttgggaggctgaggtgggcggatcatgaagtcaagagatcgagaccatcctggccaacatagtgaaaccccgtctctactaaaaatacaaaaattagccaggcatggtggtgtgcgcatataatcccagctactcaggaggctgaggcaggagaattgcttgaacctgggaggtggaggttgtagtaagccaagatggcgccattgcactccagcctggcgacagagcgagactccgtctcaaaaacaaacaaacaaacaaacaaacaaaaaacaaaaaaaaatccaccccctaagcagcaaaataaacatgagaaaaggctttatggactagaaagccatgtgcagattggggaggtgtccctaatgcctgctctcctgcccaaggcacggctgacactcagacaatcaaatcgagccgggcacccttcttgaccgccaccaaccacttccagttctcatggccccactcccccaccttcccgctggcaaaggatgggaggctgagaggggagctgaccaagatccggcagaggaacaagagtctgcttctcacccagggaagggaaaaacacacagcagggaagacaaaatgaaagaaacagagacacaaagaaaagctgcagggagtgggaggcagagaggcagaaagacacgcggacactgagggccgagcaggagcgaggggcagctctgaaggtggccccaacacactcacatacgagggcactccccactctcagctgtgctcctgtgtctctcctggttaagataaagttagaaacaacaaaatgccacatctctttgagcagcagccgtcggcagagctccatatggctgcagcagccaggagtctgagctaataaaagttaaaaaaaaaaaaaaaaagctgggaaatgctcctggagagccacgtgggcactgctcagggccgggtgggggtagggaggagagcaggcaccataggagggggtccccgcccctgcttggcgcgccaaggtctctgttctcattcagaacacccagcccttctagtaatggtgagtccaagacgcagcaaccaaatgtgctgttttagatgcctgggccctctcctacctccattccagtttctcttaatgggagaggatatgacagtcagtgctgaaagtttgcgtcccctcctctccattctcaaatgtatatgttgaaatcctaacccccaaggtgatggtatcgggaggtggggcctacgggaggtgattcagtcataaggctaaagccctcatgaatgggattggtgcccatataaaagagaccccagagagacccttcattccttccaccatgccagaatgcagcgagagggtaccatcaccagaaagcagcctcaccacacagtgaatctgccagcaccttcatcttggactttccagactccagactgtgagaaataagtatctgctgtttataagccacccagtttatggtattttgttatagcagccggaaaggactaagacagtcggcaagaacagccaggaggagccaggacaagcagtgtgtgtgtgtgtgtgtgtgtgtgtgtgtgtgtgtgttcgtgtgtgtgtgtgtgtgtgtgtatgcgtgggcgcgcatgcgtggttttcttgcagggcaccggcagcactgctcttggtggggaaggggagacagatggctggctgaggatccccacactgcggggagaatctccaatgctgaccccaccccctctgcatcctgatggaggagttggagaagaccctggtcactggataacccttcttcaaggagtctctcccctgcagacagggagtggggatgcagggaggaatcatggcttccaccccacaggttacagcggggtgggggaatacccaggcccacggtcacagtagaaacacttcagaagtctgagccaaaccccgctgtctcctgagagagaacgccagggacagaggctggaggaagtgtgtgcctgatgggaagtttcaatccattctgtaagaatttcctgaaaacagactgtgtgccagtttttatggcctctgccccagaaaagcacgcatggcaatgaaatgacactggggggaggggagggtgcacccaccctgacggtccatggatggaggccagggtactttaggacctctgaagacagcaaagcagtttctggtaatctctgaggaggtggcatttgttccagaaaaaaggaccccccaaccccatcccacagcctcaccagaccctaaagtcagaataaccggcccagctacagcccctgcggtcgtgcttagccactacagaggctgctatttccccagccagtgtccctggcagccttggaaaccaatgaagcaggctctgacacaggaatccctctgcatctttatcactggaaaagcctcgatccagcccaggcagagagcggcggattttaaaaaggaaggtttctctttgtgaaggaaatgaacatgattcagcacaagagccgatcaggaatgtggaggccagactctcccatcaggctccgctcccctcccgccacctcggcagaggccccagactgcacctgccggatgggatcccgtagtgccacagagcctgggcaccatgccactcctctctccaagaacaccaccgcctggcaggctgccaggaacagccaagccctgtggacatcactcccagaaatccaaccacacggaaagcaaacgtgctgtgtctcatgacagtactaacaagcctggtaaatcagcccacagttgcacagccgtagctggggaatccaagtgctttctgaggacacactgacgacagcagcagacacacacgcgtacgcacatcttcacggcacacagactcactaaggtatgccacgagcctacaggttttcaataccatacagtggataacagtggtggtggtgggtctccgccctcaggaagcacttgaccttatctgacaaacaaaaggaacatcagggaaaaactctgcatggattgaatgcctcccagtgtggcaggaactaagagccacatggatctctgagcttcggctgacatgcccaggaaggtggccctggaaaggtaaggtgcattcagtggaaacatgaaaagcattccaggtggaggaagaagagcaggcccagcgtagggcccccctgctcggtgtctggtagccttccaacctgcttgcctaaagaagtgttcttaggtggaggtggaaggaaaaaggtgaccttctgaggtcattatgctcatctttctgcttctaggtagtaacgacctgtccagtctccacatctccagggagtctccaggtgtctgtccattgctcagctccacttgaggggtgagttaaactcttaggtcctggctctgtggcccaggctggagtgcagaggcttgatctcggctcactgcaacctctgcttcccaagctcaagccatcctcctacctcagtctcccaagtagctgggactacaggtgcacactaccacacttggctagtttttgtatttgcatttgtagagacagccatgttgctcaggctggtcttgaactggtgagctcaagtcatctgcctgcctcagcctcctaaagtactgggattacaggtgtgagcatttcgcctggcctcagtggttcttgttggcattagctgatgtggttcctgttcccaggtgcagagtgaagccagcctcaccaccccagacagcagcaggaaccaggattccaggccctagccataccactgggaggcccaaacaagttaacataggaacagccctgcttaagaggtgtgcgccacacttcgagtaaaccaaccccatcagcctcttctcatgggaaagctggggtgctggtgaacacgaagacaggggctacctcagctgggtgtatcccagggaaacagacgcctttttctgctgctccatgacgcaggccgacagctcagtctaaaattttgaggactcagggaaactgctggggtgaagagatgacagctcaccctcaaggtggcctggcacttgccctctctcaatggcggaaggttatttcttctccagggctccttaaagacagcaggcctgagcccaaggggaaggacatctggggaaggggaaagcctggaaggatggcggccaggaaagggcagaggaatggcctctcccatccaaagctggcttgttttatctccacgagcattcgctccagatgcttctaaatgtgcagtgagtttttgatccagactgaaccctggccaggtagatggaatccaaaaaattcttgggccatgcctgagaaaggatgccacaaccctgcccctactggggccagacccaaagtgagtaaggcagattctcctgtttcacagtcaccaagagaatgtgtcttgaatggcagcaccaacaccatttcattcactttgtagcatttgctgtgctcagtaccccagatccctctttgggaaacaaagaaacacaactcagagaggttatctgctgggcccaaggtcacagctgactgaggaccggaaggcgagctgcctacttgatccttggccctggactcttctcagattacacttatcttaaagggaaggggattactttctgttccttcaaggcagctgcctggcatcctgcctgcacccctggccacagctcagggtcatttgtgctgaatgaggcctcctgatacctctccagcaagtgacaagctggagagacgccctccaaatcttagatgctgaagaggggcattcagaagaagtggcaccagcagccacaatccttcagcccaccgtgaactgccacacatgcacccgggtcaggtccctgtttccagatccccagcctggagcaagtcacagcagggagaagggtggtattggactggagcagagattctgagcttggagtctgtagctgggtttcaggggctttgtgaaccctccgaaattgcctgtgagattgcgtgagtcagtgcatttgcctgggaagattgtgtgtagctttttcagagcctcaaaaagatcaaggactcaaagaggctaagaagcacaggaacaaaggctcccgagtccccaccagccatatggctctgggcatacacaaatccagcagccaaacccaagttatcaaatgcaggagaacatgctgtgtgaatggaggtgagggctactgtcctcgctgctgcccctccctggttctgtgcctgctcattgactcccaccccagaggcctgcatgacattcctgcagaacagggtgccccacgctttgcagacccctgtctttactggctgtcttgctgaggaagaggttcttgctggtctgacccctgtgaggcttgtgtgttctcaaggctctcactagctgctcattccctttctgaacatcaccaccaccagactagagaaggaaactggaatggaaaggaaaatgcaattttggagaaagagccacttcagtgcacagcacaaatccagctggacattcctccaaatggcctcagggtcctagaaagccacctctctgtcataggcaagtgaacactcctgtgctccactcccacactgctcaaggcccatgaccactttcgggaggggtcctgctccatccgttccaggccacacagggcagctccaggcccacggcccttgcatccccagccaggggttaagggagcccaacaggagcccagaagcccagagcctgaggacctgctgctttcacagaaaagggggaagtctgataagccccctcccacccccccatcagccctcccagtcctgcagctgaggcgggtaccaggacaccaataagacccatgtgcagatgtctgaggaaatgcttcttgtttcaaggatcccacagtggggctgcaggggcttatctactctccctcaaggcagggagaagctcagtgtccccaggatgtggaatcacactcagccctacagggactggggagcccaaagtatctgcccactttgggtccagtctcctcccgtgggcctccaagcggccctccatcatgcaagcttcgctctggtcttgcaccctccaagaagtgcttgccagctccctctgttcttctgtatcccccaaagcacccattgcagggtgggggaaacagcatgtgatcaggaaaaccttactgtatggtgtgtaaataggataccatggtctggaaaacccaatattctgtttaaaagtgaaagagttactataaaggccatatgtcagcttccaattttcaaaagacaaagaaatacacactgctaaagttcagtggtgcataatgtcatctttctttgatgactgaactcagagaaggcacatggggatccagcagcgtctcgggcatcattctggaagttgttggggaaaacagaggcagaagcagaagtcccacatcttcccaagtcccctcgtctctgcttgcctctccctgtgcagtgcacagcttggggacacatactttagggtaagagcgcaccagatacaaaggtggggaagagtgctgcagaacccaagagggatgtgggtctgattagattttggaagctcctcccaagaaggtgctcctacagcctctttcagcagcgactggaaaaccccagaaaggtcacctgagattttccctctgccatccacggtagactccacctctaatggggtcagtctagcaagaatatggggcctggattgtctacccaccaaagccaggccaagacaacctgcttggtgatgcaggagagcagctttgcactcccctgcctgtcttatactcaacaaaatccatggcatgggccatgctcctctccccaccaaagaaactgacaaaggaaaacaagccacagagaggtgagtgatagcattagcctcagggcagccccaaagcagagggaactggccaattccgcaacatctgtccctagccagtgggacaggcacaggctaaggacagagtcctggcagtctcctgaagttgctgctggccaggtggtcacacagggcaccaaatccagctcccctgtctctaccgctttccgcaggggctcatggttgaggatctgctgaagttagtcaggggagaggaaacagtctcctccttgaactacaatccaggatgcctcccaggcgagtgaaggacctagggactggaatctcattggccccagggctgtgcccctggactcgctctcgggaagccaagccaggtccaactgataaccgcattccttgaggaccctcggccgggagtgactgccagtgggcagacaggaagaaaagagccctggcccagatcaggcaggcatccctgcttccccgcccaccgactgtccccggagaccagcctccttctctgcctgcggaggagagcagtggggacattatgccaacaggtccccttcggcgggcctcacccggccagccttcctccgccctgccctgaggccccacattcagcggaagcgccgaggcacctgctgccagacagggctccatccccgcggaaggggcccctgggcggtgcccctcggtgcccccggcttcctcggttagggatggggcgccccccccggcccagcacgccccctggcccggcgcgccccccgcgccccctccccgcgctcacctggcgcaggtgctgcagcagcgtccccgcctcctcccgccggccctggcgcaccatccgcagcagctcctggaccatgccgactcgccggtggtaggggggcatccccgcgcccgcgcgccccgccttgtccccggcgcgcagcagcagcgacgcccagaagtccggccgttcgcgtcgggggcccggcgcggcgccggggctggctctctccgccaggctgcccttggtctgccgggtgcccatgccgccgccgcccgccgggactctccgctctgggccgcgaggccgcgtccccgccaaccgcccgcccctcggccgcccgtgcgcgctcgcctcccgggctgcaactttgggggaactgttgcgcgcgggcgtcgcgggggcgggcgggcgggcggctgtcggcgctccccgcgctcctccctcttggctacccgggcgcgctccccgggcgctcgccgccggcccgcccgccggccccgccccggcccggctcggcccgccccgccccccgcctccgcgccggagctccgcggcgtcgcgcgcctccctcttctcgggctcccgctccttcccgccccgcggctccgggctggggaccaccaccaggcgccccctgcctgcgtcctctcggcagtcgcgcctcctgcgggcggcagtgctgcgcttcccggggccgtggcgcgggggcgaggggaacaggcaggccccatgggccgtcgctctcggtccccaccgggctccccgacgcttccaccaccgcgcgcccggtgcgtcgggcgagatggggaaagtttggagcatgggggtgtgtgtgttggggggctctcttaggcccagagtcgggtttctcaaggtgggttccgctgagcctcagcgcccaaatcgtcggaggcgctggttaaaaacgcaggctctaaggcctccaccgagacctactgaatgataatctcctcggtggggcctgggatccgcctttttagccagcatgttgggtgattcccatgcacgctcctttgagacctggcctgcttgcagggcgctgtagtggtgtggttggtgcgtaaacctggaaactgtgcgagcttatgggttgtgtgcgtgcccttctatggagagggcctgttgcttccatcatgctctcaaagcatctggaccggagaggtgtgaactcctgtgttctcttgttctcactctcacagccctggagaagggtccctggggtagtcctggtacaacaaagcaaacgcacgtctgcgagtaggcccagcggtacaccctgctggcccaccttcctccccgtgcctctgccaggcccagtctgtaagggaccagagccctgggatctcatggtgttgccagggcttgccagagtgaaggcgaaggcaggtgggggagcttctctgttgcagaccacaggccgccctggtcccagcgcagggcagaagcaattgtgcaagctcgcctctgaccccagctctgggtgttgcttgagggtgtaagggcacgtgggctgtaggggcaggaggctggatcccaaatcacagggagctgagccccactacttagtgagcactgagtatcaggcgagtcttcagcttcttgagtcctgattcttcctgtcaggctaggataataacactgccaagaattgggagagtaaactcggtggacactgctaaaggaaaaaattatttaatgacatgagttaaagcatcgtaaggaagactttattcaggaccattaccataggtgtagggacctctgctatgagattttgcagttgcagggagagagagattgagctcaactccaattacagcatgggcaagtgggaattcgttgctaaggagcagggtgggggtcagcggatagaaacttaataagggaaacatcagggctgagggggattctggctaaacaggttgtatggagcacccttgacataagtaactccatcttagaaaaagggtccattttacatttgaaaaagcctcatgccaacaggaaccagatgttcgcctaatcaataaagactacaccccaccagataaagacataaacaggcacactctttgctatcagtcctcaccagaggattctgtagccataaaaagagcaggacttcagcaactggagatgaccgtctggatagaccccatcttgcccacactctgcccacatcaaagactcttccttgcaagacactgaggactgtttggatcaggccaggagactccccttgtccaagtcactctccttggactatattgttaaccgctccttccctatccccttttctcttgatgttaaatgtactttgatgtggaatgtgtaatctataacatttatatattgattaagtatactaccatgtatggttggcagtattgactgacttgtggagtgacttgagcctgtatgcccacagctcttattaccaagtgaatggggaaaactaaggagaatttgcctccttgagaaccccatgtggcttgtggcttttatgactgaaatagcatcaataaaagcctgacgttgtagaaagacacacatgtgcatgaacctgattatttctgactttgtggcactcacaacaccaacctaacagaattcttgctttagacaggccaggtgaccagagatcacctgggggagggtgggggatgataaacctaatcagatattgaagatgatcagatatacaagatggagggttcttgctaaactgtcttaacagggtctttgctaaaactggattttacatggaagtgcaaagagggtctaggagaaggtttgggagcctgactaaagtttggccaagcaaagaatctttgtcaatatataaacttcaagcagagtagagatgttctgcaaatgagttcctcttcctgctctgtgatcacagggttttccataggtgtcttctccgttatccctgagtaccttgagtatgagtcctggcatctctcctgcaggcattctcttccctttggccaccccactcccaaatgtccatctctgccagcagagaacactcagtcttcctacaagctggctttgcagggcttggacagcactttccaaacttacctgaaccctttgcataggagcacacacctgctggcatctccagagaacccagcttgaaaaatacttatgtgtctctcatctctggtctgcaggaccaccagacaaagtggccaccaaggacacctattgaccaggcccctccctacagacagtgagctctacccacctggagacagaccacacaacctagatagcctgttggcctgcttgagggtgtgtggttggggcaaatgccatttcaatgggagaggggccagaccagcccctcacttgggatctgaatgttagccctctcctctttttcagagacctgattctatcctcctccccttgctcttgatttttttaccctgacttttcctgttttctggcttgttctcctcaagatatgctctactcacctctcttccatctattgaaaaatttcatttgcatctgcctgcttcagtcaccagtgccccaactttatcctttcttttcagctaagatttttagtttccctccctccctccctcccttccctccctccttccttccttcctcccttctttccttttctctctctgtcttcctccctcccttctttttttttgagacagggtctcaccctgtagcccaggctgaagtgcagtggcaccatcacggttcactgcaaacttgatctcctgggctcaagctagcttcccacttcagcctcccaagtagccaggatcacaggtgcacgccaccatgcctagctaatttttgtaatttttttttgtagagacggttttaccatgttgcccaggctggtcttgaactcctggcctcaagcaatcctcaggccttggccccccaaagtgctggaattacaggtatcagtcaccacgcccagcctattgtcattctttctttacctccattcgttcctcacccacttcagcttggcttctggccacaccatgtcactaaaatgcctcttgcctttagcctttagcaacagctaaagaagtgacctagttgctacactcagtggccacattcagtcttcatcttacttgacttttaagcagcatctgatcctgttgcctactcttttgattgaaactctactcccttggcttgcaaggaactactctcctctaggtttctttcttgagttctcctgggagctccttttcttaccctcattctttacttgttgcctttatgcagggtactaccccgtatctcttcctaggcaatgctatttatttattcatttatttgagacagagtctcaaataaacttatttgagacagggtcacccaggctggagtgcagtggtgcaatcatagctcactgcagccttgaactcctgggctcaaggacactcctgtttcagccacccgcgtttctggcactacaggcacattaccaacatgctctgctgggcaatattatttgtaatcatggctttacttgccatgtacacgctgatgactctttccaacttataagctaataaattaacctgtcattgattcatggatgctaaaagaagacatgacactctgtggtcagaaacataggactttgttactcagagcacagcaagaagcatgtgcatcagcatatttgcctccaagtctcacaggggcaatatggggggcccagatggatgttccacaggcagctggttagcgtcatagctgaggaacaccgagcctggagctgcttatgcagggaggagtaagcaagcctgctcttcctcctccagggagatggtacctcatccctcaaggcggctcgctgtaaacacagcactgagaagtggcccaggttaaaaatggtcagggtcttgcaatcttggcatacacagcaagatgtgtgagagtgcaagggacccacggaggatcatctcttccaatagtgagcacttcatgctcgacaaatgagcgcatcctcttccaggcctccctcccaatctacccactcctgtctccgcttttagtaacagcaggccagaaacccgggagtcattgtgcactctttgtttaacctgcatcttgttaaccaaggatagttaatgatgccaaggatgggagctctcatttgctgcgcatttcctgtgtgctcggtcttggggtgtgttctttgcatatattaggcaattcatcctttccacagctgcgaggtaggctttgttattgtcctgatttcccaggtgaggaaatggaagcttagagaggttaaatgacttggccaaggtcacacaggtagtaaagggcagtgttgagattcacgcttaggtctgctagcattgttaaggtcctacattttttttttagacaaggtctcactcccgtcactgaggctggaatgcagtgacgtgatcatggctcactgcagccttgacctcccaggctcaggtgatcttccgacctcagcctccgtaactgctgggactataggcatgcatcaccatgactggctaatttttgtattttttgtatagacggggttccactatgttgcccaggctggtctcgagctcctaagctcacgaggttcaccagcctcagcctcccaaagtgttggaattgtaggcataagccactgtccctggccttgatcctcctttttttttttttgagatggaatcttgctctgtcacccaggctggagtgcagtggtgccatttcggctcactgcaacctccatctcccgagatcaagcgattctcctgcctcagcctccctagtagctgggactacaggcacatgctaccacgcccagctaatttttgtatttttaagtaaagacagggtttcaccatgttggccaggacagtctcgatctcttgacctcgtaatccgcccacctcggctgcccaaagtgctgggcttacaggcgtgagccaccatgccctgccggtcctacgtttaaaatactttcccttcctacagccactgccttggttgaggatctgtcattttcaccctaactttctttctaacttgtctccccacctccagccttgcctcctctgatgcatcttccacaaaacagttggagtgatcattgtagaagagaatctctgtctccctctccccttcagtgatttctgtcactttcagtctaaactgcatacgatggcattgatatcccgaggtgctaccatgtcctcatgtccttgacatcagtcatcattccacattccctaccactctcccaagacaccacattttgtgcctttgtacatgtggcattatcttcctagggtgtccttcacctccttaatagatacctggccatcccttaaggctcgttgtagatatcacctccctcaggaagcctcccccagtgcccccacgtccccttatgtgactataaggctctgtgaataggaaagcacatcctgtactgtgcttctcctgtttgtttgctgcgcttctgctcggggcatccttcttcatcccctcattggttaatccctccttgacctttagactaaactcgtgtttcctcctcagggatggcttctaggattcccttggctctcaccggctaaagtcaggagtccctctcatgtgttctttgagtctcattgtctgcaccagactctacagtaatggctataagtctctcaaggccagattgttattagtgggagccgttgtccatcagtgccgacacagcacagcaccaggcgcactggaagagccccataaatacttgctgaatgaagcaactccatggccacctccaatggcttagcttcatgccaggaactcagtatagggcaggtgctcaatgaaagggatggaatgaaacagagagctaaaatgcccattggatttgttgacatggaagctactgattgatgatcttcaggaaatcagtttccagggaatgagagagcaaccagaaggcaggtaaagaagttgagagcgtgattgtagcttgttctgtcaagaaactcaattgggaataggacaataaccagaggggtacagggcagagaaggctgttgatgttgctgttgtttttaggtttttaacaagggagatcaccttattcaagagataatcatggaatttatcctctcaagaataattctcttataagcaagtaatttctgtaatatagaaacattggacttttctcaccatcaaatctggaattaaaaaattctcatcgtgactttacttggaacatccacttcagtttctgatcatgttgtaaggatttgaaccataagatgcctaatgaaatttaaagatcattcatattatataaatgtttaaataaaaaaatctaacatatggatcaagctgtaaatatttttattcgacatgtcaagctcttatcactttgattaaaaattttgtatttgggccgggcgcggtggctcacacctgtaatcccagcactttgggaggcccaggcaggctgatcacgaggtcaagagatcgagacctgcatggccaacatggtgaaaccccatgtcttctaaaattacaaaaattagtcgggcgtggtagcgcgcgcctataatcccagctactcaggaggctgaggcaggagaattgcttgaaaccggaaggtggagactgcagtgagcgagattgccccactgcattctagcctgggcaacaagagcgaaattctgtcccctgccccctcaaaaaatttgtatttgggccaggcgtggtggctcaggtctgtaatcccagcactttgggaggccaaggtgggttgatcacgaggtcaggagatcaagaccatcctgtctaacacggtgaaaccccatctctactaaaaatacaaaaattagctggtcatggtagcgcgtgcctgtagtcccggctactcaggaggctgaggcaggagaatcacttgatcccgggaggtggaggttgcagtgagccaaaatggcgccactacactccagcctgggtgacagagtgagagtctgtctcaaaaacaaacaaacaaaaagcacacacaaaaaaacttacacttgtaatatttaacccttttcttaataatcatacaaaagttgttatgatacctctttttacagcagaagaagctggaatatagaaaaagtaaataatttgaccaatgcctccttgatagtcattggagagctggaattcaaaactatgtctgcactatgttagagaatatagattctcagtttatattttttgaaaatttggaccaggcatagtggctcacacctgtaatcccagcactttgggaggccaaggcaggaggatcacttgagcccaggagttcaagaccagcctgggcaacatagcaagatcctgtctctacaaaaaataaaaagacaaatttcctgggtgtggtggcacgcacttgtagtctcacctacttgggaggctaaagctggaggatttcatgagcctgggaattcaaggttgcagtgaactatgatcccaccattgcactccagcctgggtgacagagtgagaccctgtctctaaaaataatgtgtttgaaaacgttgtcacatagttgctgtttgtttttaaacataagaagagaacctgggaagggaggaagcacaggtgaggcctgagtcccctgggcccatgtggggagatgacctggtacagctggagggatgagccactgatgtgcgccaggtagactcgcactgattcagaaaaggaggaggaggccgggcgtggtggttcatgcctttaatcacagcactttgggaggcagaggcaggcagaacacgaggtcaggagatcgagaccatcctggctaagacggtaaaatcccgtctctacttaaaaaaaaaaaaaaaaaaaaaaaaccacaaaagaaattagccgggcatggtggcgggcgccttttgtcccagctactcgggatgctgaggcaggagaatggagtgaacccgggaggcggagcttgcagtgagccaagatcgcgccactgcactccagcctgggcgacagagtgagactccgtctcaaaaaaaaaaaaaaaaaaaaagaaagaaaaaaaagaaaaggaggaggagagatgcaaacaagtttgcagatggaagagaaattggaggagttttggccttacagtcttactttctttttttcaacgccatcaaaactacctgctaaaatgcaggggagaaaagcagggcatgggcgtgtggagagagctggtcaagggaccacagctgggaagcttctgcagaggcaggagacaggagctcagagtggcatcctgcggctatgaggtttgctctgactgctcctgacatctcaagaaataggggatgaggttgattccctgctgaggtttcctagggcattcatttgtgatggagggatggggaaagatgggtgatagcaggtcctggacaccatgacctgtgaaatattgtctggaaaggtgatgaagcaagaaggaatccagggacgggtacaatgcaccactggtttaggtggtgctcaaacttgagcatgcatcggaatcccctggagggcttgtaaaggcgcagactgctgagcaccagagtgtctgattcagcagggcagggcatgtgcatttcccaggagtttccagggatgcagatgctgctggtcaggttgaggaccacgctttgaggagagccagaagagctgggatgtggggaggaggtaaatgagagtttttctctcctgaggtctcattaagatttccaagaggacagaaccatttttagactcagaggaatttagggtgtcattgaaagtactgactgtgaggggacaccaaatacatacacacacactcacacacacacagtcactctctctcacacactcacacgcacacacacacacacactcacacaacaaagagatccctgtccattagttgacaaaggttctctgcttgaccaaactttagtcaggctcctgagccttttcctaggcccatctgtgcacttccatgtaaaatccagtttagctaagaaccgtgctaagtcagtttagcaagaatcccctcacccttaatatcggatcaggttcctcagcctccaccatcccgcaggtgacacctggtttaccctggcctgtcttcagcaagaatcctgttaggtgcgtttagccagaatcccccttacctctgatgtttcctcttagtaatttcccgtccactgacccccaccctgctccttggctataaactcccacttgcaccagctgtattcagagttgagcccaatctctcaccctactgcaagaccctgttgcagtggtccctacgcctattgcaatggtccctacgcctattgcaatggtcctgaacaaagtattccttaccatgatttaccaagtgtcttagtctgttttgtgttggtttaaggaacagctgagactgggtaacttataaagaaaaaaggtttatttggctcatgattctgatgtctggaaaagttcaagactaggcatctggtgagggcctcagggtgcttccactcatggcagatggtgagagggacctggtgtatgcagatcacatggcaagagaggaggtgagagagacagcggagctcttttcaacaaccagttctggcagcgactaatggagcgagaactcattcacccccaaccaccccagggaattattctattcatgaggcatctgtccccatgacccaaacacctccccttaggccccaccccccaaactggggatacattttggcatgaggtttttgggaacaaacatctaaactttagcactatgtataattgaataactttttttttttttttttgagacagagtctcactgtcgcccaggctggagtgcagtggcgcaatctcggctcactgcaagctctgcctcctgggttcacgccattctccggcctcagcctcccgagtagttgggactacaggcgcccgccaccacacctggctaattttttgtatttttttttagtagagacagggtttcaccgtgttagccaggatggtctcgatctcctgaccttgtgatccgcctgcctcggcctcccaaagtgctgggattacaggcttgagccgccgcgcccggccataactttttttttaataagtttattttcttctcaaagaagacacaccccaccccttttctagggtgcccaggttagcccacttctcttttggcagctcttccaaacctggtgacttcttttatttctttttctttctttctttctttctttttttttgagacagagtatccctctgtcacccaggctggagtacagtggcacgatctcagctccctgcaacctccatttcccaggttcaaccgattctcatgccttagcgtcctgattagctgggattacaggcgtttgccaccacacctggctaatttttgtatttttagtagagatggggtttcgccatgctggccatggctggtctcgaactcatgaccttagatgatccacctgcctcggcctctccaagtgctgggattacaggtgtgagccactgcgcttggccccaaccctggtgacttcttttggtgaccaggtaaaatgtttcagagttcctaaataatgacgtatgccagggatgaatgcaaacccctacattttcatccaaaaactagacagtacaagaaaacgcctgtgtgacatcccaaacatccagcccggcttttaatcaggaacctagaagccataggatacctcgcccaggcctttggcagacagcatactgtcagatgttcagaaacactgacgagagaaatgtcctttgcaggagagagagccagtggagggcaggagaactggcatccaggtctccatgaggtataagctctcttcttgcaaacagaacaccagaaggacgcatcttgggacccatccactgagtgccactgagaactgtgggtgagctgccttcgtgcttttcccctctattctctaattatttcttcattgctccatgcatggcttactttaatttggttatttaatctgttacataagaggtgtccatgaactcaccatgcaaaacaaaacagaaccaagccaggtccttgacaagaagtgactgactcatagggttctctgccatcccattgctctgcctccccccatgtcaatatctgcatcctgaatctgatgttcatcattccttccttttctcttcatattattttaaactttcttttttataatggaaaatttcaaaaatacacaaaactagagactagtctattgaaactacatgtacctgtgtccacattttaacttcaaatcataccctgccttgctttatcctacccccaccccacatttcctctgtttccacatttttaagccattgtattttatttatatttgtccctaaagggtgtctatttctattttggttgtctctaacttgataaaaatacatcctgcagtatttttttttttttgaagagactttttttccccatgtactattgtattggtaagaatcatcctcattgctgcctgtcactggagttcattcattctgtgtcctttgtatcttgatttatttctccactcgcctctagatggccattcaagttgaaggtttttgctattgtgaagggcgctgctgtaaatattctttttttttgagacggagtctcgctctgtcacccaggctggagtgcagtggtgcaatcttggctaactgcaaccttcacctcctgggttcaagccattctcctgcctcggcctctggagtagccgggactacaggcacgcgccaccacacctggctaatttttgtatttttagtagagacagggtttcaccatgttggccaggatggtctcgatctcttgacctcgtgctccgcttgccttggcctcccaaagtgctaggattacaggcataagccaccacgcctggcctacaaatattcttacacattctcctcctacacctggtatagtcctaggagtggaattatttaactttaagattaatgctggattattttccaaagtggctacagcaaattacttcccctcccctgtagcactggattcccctcatccatatcctctgctcccctccaatgcttttattgataagcttattaattttttctgattacctggccaactaaaatggaatccaatttgggccttcatttacataaataccataggctgggtttttgcttacttggaacttgtcactccttccttcttttttatttctcctttttgaaatgggagtgtttatcctatgcctgtcccaccaatgtattttgtaagcacataatacagtgcttacttgtctggcttcacaggttcatagctggagaggaatgttttcttgggataaatcataccttgagtctcacccgtatctgatttagataacattcagatcagactttggactttagactttagggttgttgctggaatgagttaagacttttggttatgttgggatggaataaatgtattttgtatgctttaaggacacgaattttgggggagtcactggggtgaaatgctatggactgaattatgtcccccaaaatttgtatattaaagtcttaatccccagggtgaagatatttggagatgggaactttgggaggtaattagatttagttgaagtcctgagtgtgggattagtgcccttgtaagaagaccatggagagtttgtgccacccaatccaccaaaagggccatgtgagaacacagcatgaagacggctgtgtacaagccaagaacgcaggtcccttgcaggaacccgaattgtttccctgcaacttccagcctccaggactgtgagaaaataaatgactgcagtataagccccacagcctatggtattttgttagggcagccagagctgactaagacagctggtgctgttgaccatctcttcatctgtttaccggcccatctctttccttttcagttaaatgcctgatcacatattttgtctgtttttcgattaggtggttctattaggtaccaagagctgctgtaagcaattaccacaaacttggcagcttaaaacaacacagttctattacctcacagttctggaggtcagaaagctgaagtgggtctcgcaaggctaaagtcaaggtgtgcagactgcccgccttatagaggctctcaggagaattcgtttcctcacctgtcccagcttctaggagttgcccgaattccatggctcatggccccttccagcaatcacatcactctggcctgtttttgtttttatctttctctccctgatcctcctgcccccatcttctaaggacctttgtgattacagtaggcccacgcaggtattctcgtataatgttcccatctcaagatccttaatacaatcatatctgcaatgtccctcttgccatgtagggtaacatattcagaggtttgagggatacggttgtgagtctgcttggggagagggacattgttctgcctaccacggttgtgctcttgccttttttcatgggtcagtataagagaagcctcctaatagaaaataaaaagtgttagccaggatgtggagaaattagagtccttgtgccctgctggtgggaatgtaaaatggcgcggcagctgtggaaaacaatatggtggtgcctcaaaaaattcaagatggaatttccatgtgatccagcaattccacctctgggtatatacccaaaggagatgaaagcagggactcagtcagatacttgtgaccccatgttcacagcagcattcttcacaatagccaaaaggaggaagcaacccaagtgtctatcaatagatgatggataaacaaatgtggaatatacagacagtggaatgttatccagccttgaaaagaaggaaatcctgacaaatgctacaacatggctaaaccttgaggacgttatgctaaatgaaataagcgagacacaaaagaagagctattgtaagattctacttatatgagatacctagagtagttaatttcatagagacagaaagtagaatggtgggcctagtgcagtggctcatgcctataatctcagcactttgaaaggccaaggcaggaggattgcttgaggctgagagtttgaggccagcctgggcagcatagtgagaacctctctctacaaaaaattaaattaaactgaaaaaaaatgtagaatggtggttgccagaggctaggataagagaatagggagttactgtttaatgggtagagtttttgtttcctaagaaggtggtggagttctgtagatagatggagagtctgggttttctaaaatggggagagttctgtagacagatgatggtgatggttgcataataatgtgaatgtggctgggcgcggtggctcacgcctgtaatcccagcactttgggaggctgaggcaggtggatcacctgaggtcaggagtttgagaccaacatggcgaaacctcgtctctactaaaaacacaaaaattagccaggcatggtgtcacacgcctgtaatcccagctactcgggaggctgaggcagagaattgcttgaacccaggaggtggagtttgcagtgagctgagattgcaccactgcactccagcctgggcaaccgagtgagactctgtctcaaaaaaaaaaaaaaaagtgaatgtacttaacactactgaattgtacactcaaaagtggttgagatagtaaattttatgttatgtgtactttttaccacaattaaaaaaatgaagagtgacatatcagcatttgcatgtgcagtattgttcatttttttgttcaataaactcttttttaaaaacaattatttatttattattattttttaagagatggggtcttgcttttttgcccaggctgcagtgaagtggcatgatcatagcttacggtagtctcaaacttctggactcaagtgattctcctgcctcaacctctcaagtagctaggactacaggcgtgccaccatgcccagcaaatttttcatagagacagagactcactatgttgcccggggtgatctcaaactctggggctgaagcaatcctccaacctcagtctcccaaagtgctgggattacaggtgtgagctaccatgcctggcctcaataaactcttattagtgaataagcattctccagatcctgtgtcaggcactggggctcccaagaagaataagacactgtccctgtcctcagagctcatggtttcagagggacaaggcacacagttgagcaatgtatgcaacagagtgctctagagtattctgggtaataaaagcctgcaggtgacttgaggaatataggggagggagtggctggttcttctggcaggctacagtgcgagtcaggaagcctttctggaaaatgtaacatgtgacctgatttctgaagcctgaacaagtagtcaccaagcttcaggggttagggagggagaagtttgagcaatgcaggggcctgacatgtcgtggtgtgttcatggctctgcacttggttctttggggctcgaggtgacagaggaagcctgggccagcagcggatagggtagagaaggaagcagaggccagactacagagagtcagtctctggctgggtgaggtgctggacactccctgtaggccatgggaatggcctataggacagattctgagcaggagggtgacaggatcgccttgaagttagaaccatcactcggcaatgcaagattacttatccgatttattcattcttgcttccagactatgtagaaactggcaaaaagcctaaaagtctagtgttttcaggcctgtttggagagaatgatggacatgggtttgtgaaatatcaaatgcttgttctgacccaaattgctcataatcagaaagagtaccttttcttttttttcttttttttgagatagggtcttactctgttgcccaggctggagtgcagtggcatgatcatagctcactgcagccttgaactcctggattcaagggatcctcccaactcagcctactgagcatctggaactacagtgtatgccaacacacttggctaattttgtattttttagtagagagagagtctcgctattttgcccaggctggtcttgaactcctggccccaaaggatcctcccaccttggcctcccaatgtgttaggattataggcctgagccactgcactcagccagaggagtatgaatacttagatatttgcacacaaatctcagtctgacataagtctgcaactccagcagcaaaaaaaagtctctattctcttttctcagcagtgtttcaaattgagccttattgattatgaccttgtagtttatctctcgcaagtagctttctaataaaaaatacttatgtaactgtctttacttaatgttcaagagtctagcatattctccgtgaatcaggagactaatattttatgctggcagtgacacagaaacccacagttcattgtctgagactacagcttgtcccaaagatccccatggaacacgaagtaatccccatcagctacagccagaaaatcagtttcctatgaagttagaacaatacggctgggtttccaggaggtaaagcatcctgaagctttgctggatggtattatttctggttttcgccaggctgcaaagaattttcacttgttataatagggcagtccatttcctgcaaagaaatatctttcctaggggtctgtctactctatagctcacaatgttcagaaataacaagaactttacaagtgtttacaaacatcgtcttgtgttaggcaagtatcaaaaaatcttgtctctcacagacgtttcagagaatccacacaaataactcagaaagtctgttcattgcagaaaagctagtatgagtttgccttttttttttttttttttgagacaagttcttgctctgtcacccatgctggagtgcagtggcgcaatcatggctcactgcagcctcaaattcctgggctcaagtgattccccttcttcagcctcctgagtagctgagactatagggacatgccaccatacccagctaatttttttttttttgagacagagtctcactctgtcacccaggctggagtgcagtggtgcgatctcagctcactacaacctccgcctcctgggttcaagcaattctcctgcctcagcctccggagcagctgggactacaggcacgtgccatcatgcccagctaatttttgtatttttagtgaaatggggtttcatcatgttggccaggctggtctcgaactcctgacctgaggtggtccactcgcctcggcctcccaaagtgctggcattacaggtgtgagccaccacacccggcgaatacccagctaatttaaaaaaatttttgtacagacagggtctcaccacgttgcccaggctggtctcgaactcctgcactcaagccatcctcctgtcttggcttccctaagtgttgggattacaggtacaagccactgcacctggcctgttctgacttttgtgcggcgtgaagtgaagaaacttaacagggcatttcctttcgtgctgttctggctgtgatgagcatttgcagaatccctgggcattattctcatggcattactctctcactaaagagtctgagggctcgaagtcattatcactcagttctctctgaaacttcaagtcagcatctcagctattctgtcaatgttgtgagcaaaaactagtagccacactttccaagtgacagagaggaagtgtgagcatgccacttcattacatttcctctccggttgacagaagattctgaccattcctcttgttgtctagaacaatggcgggtgattttgtgtccaaaggtcatgtggcaatgtttagagacattttccattgtcatgactggggttgagggagctactggcatcaggtgggtagaggccagggatgttgctaaacatcctacaatgcccggacggcctcctctccgcgaaaagaattttccagtctaaaataccaatggtgtcaagattaagaaatcctggtctagaactagaatccaaatgccccagtgccagccatttagttctctcagaaagcagacttttctgcccaccccaatcatgttccccttttgtagtgatggaagttataacaagatgcaagaccagattacattttccagccttctttgcagtttagtgtggccatttcagtagctcccaccaatggaacaagacctaaagtgatgtgtgccactctggccaaggcttctgagaattcccttttcccttctgctggcaagatgtagatgacaactaggctgtatgggagagccatgatgggagcctggatccctgcatcgccctatggcagagagctgcccatcagctgaaaacacatgctgcagtcgcttatgtgagtgagaaataaactcctgtgtttgagccaatttacatctttaggtctacttgtcacagcagcttagctcaccctagccagtaaacagccaatccccaagagcctattttgatgctaggagccttaggaagcagagagagctctgaatgaggcaaacatggcagggatctttgcccctgaggttagcttgggtcccctctgctaaatggtaggagcagcgcaagttcaagcctgccatcaaggggcccttgctttgtttagtacagccttgacttcaggagtaggttgtgatatgatccccactctgtgtgatttcagctacgtcatcacgattagacacttaggctactccgatggtccattttatctgtcagctcaactgggccactagatgcccagatatctggtcaaacattattctgctgtgtctgtgaaggtgtttctggacgaggtcagaatttgaatctgtagactgagtgaggctgattgttctctctaatgtgggtgagctgcatcccatcagttgaaggcctgggtagaacacaaaggctgagtaataggaaaccccttcctgcctgactgtggggaccaggacattggtctttttctgtctttggtctcaaacagaaacatctgctcttcttgggtcttgagcctgtggctttcagactggaatgtatactcctgggtcttcaacttgctgactgcagatcttgggaagtttcagcctccataattgcacaggccaattccttacaataaatctctctctgtctctgtctctctctttctctacacacacacacacacacacacacacacacacacacacacacacgcatcctgttggttcttttcctctggagaaccctaatacagttgcaaattgcagaaactcacctgaaagcagtttaggcagaaaagggaagaggctcagagaaccaaagcacaggaagtgatggggtgcagctggccgcagggacagctggaccagcagggcgcattttctccacctcttatccccactgctctgggtgtgttggcttcattctctctttgtgcagttaagcctcttcacacagcagggaaaaagcatcatgatctctaagctcatatcctcacagctgctgggccaaagaggaagcgtcctccctgtctctcacttgaaaattctgggagggacttgggttgagcatccctgctgtgcctggagcaggctgtattatcaggagaaataaggaatgggcataaaaaatggctgtacattgtttcttgcatgtactctgtgacattgggatatggtcactgtccccttccacttctgctggctcatctttgcctcccatccctgctactttgacccagggaatcaaagtgtagcctcagggagcaaattacagaatttttttccaacaacccctcccccaccactcctacattggcagtggtggctgtccaaaacgtgacaggagaaaattctaactgtgcaaaatgtgatagatcctacaacatgatgatacatgagatctgtcatgtaactcaagctggaaaaatttcagcaagataaactgactgccatacatcttaactagtccctgtccagtttctattggctaatgctagtttgtttcttttatttttttgagatggagtcttgctgtgtcacccaggctggagtgcagtggcgcaatctcagctcactgcaactcccgcctcatggattcaaggggtccttctctctcagcctcccaagtagctgggattacagatgcgtgccaccatgtccagctaatttttgtatattcttagtagagacgggatttcactatgttggccaggctggtcttgaactcctgacctcaggtgatccacccgcctcagcctcccaaagtgttgggattacaggcgtgagccaccgtgcctggcccatcctagtttctttctttcttttttttttttttgagatggagtttcactcttgttgcccaggctggagtgcaatggcatgatcttggctcatagcaacctccgcctcccgggttcaagccattctcctgcctcagcttcccaagtagctgggattataggcatgcgccaccacgcctggctaattttgtatttttagtagagaaggggtttctccatgttggtcaggctggtctcaaactctggacctcaggtgatccacacacctcggcctcccaaagtgctgggattacaggcgtgagccactgcgcccggccatttatttcattcatcatacttatcatactctgtgattccttgcttgatttgtttacttgtttactgtccacctttcctaccagaattaagctccctgagggccaggttccatctgtcttggttcttgcagtgcctccgtacctggcacagtggttggcatgcccctgcttgtgatgtgtgtaacagaatatgccttttgccaatgctcagggtgttgctggggttttgctgaggttttccacttttctctgcacatggtgacttaaaggtctgcaggcacttctttgaatctactcttatttccgccatgcctcgcagaagttccttgaggtctctgaggcctgagcggccgttttcttctatgtctagtgtaatcaccctctactttcatactcttttagtcatttcagtgacaacttggaagatggggattcccggtacgagattggaaaggcataaaatgatacggcagtgatcgctctttggagatggtgctcatagtctcaccttccaggggtttttccttcattctacaaatatttatttattggcaggggctcggttcactctcttgagccactctcttgggcaagttccaagtcctcatgttgacctgtctgccgcatttgccattgcgactgctctttcctgtctggggctttctccaccctcttgtttctcaatgcagtaggggtcaagaccctgctccttcctagtttgccttcttcctctttgacatcacctctccatcttcctcagagaatccccccttccttcagtataccacatggcacactggtccactgatttgcccttgtccagcttctcttcccaggcagtctcctccgaggcctttggttcagttcccttctgcaggagctggttctcaattgcgcgtgtggagtcagagcacaatcacatctcaaactcaacacgtgcagggtggaggtcgcttcctccccacacccttgctcctctcgcttctctttccctcagcatttccctgctcctcatccaacttgcagccaactcttgtggattctacattcccagcatctctctgggaccctacctctccatcctggctacccttgccttagtcccagccagaatcatgtttttgttttgttttgttttgttttcccaagacaaagtctttttctgtcacccaggctggagtgcagtggctcgatcttggctcgctgcaacttccgcctcttgggttcaagtggttctcctgccccagcctcccgagtagctgggattacaggcgcgtgccaccacgcctggctaatttttgtatttttagtagagacagggtttcaccatgttggccaggctggtctcgaactcctgacctcgtgatccacccacctcagcctcccaaagtgttgggattacaggcgtgagccacggtgtctgacccatgttttatgtctgttagtgtgacccctatcttcttgcctccagttcttctctccttttagctcctccatgcctcctttaaatgatcttcctataatacagcattgtactatatctgcaatacagcattgtatccgacttcctcctttcatttatttatttatttttttttgagatggagtcctgcttttgttgcccaggctggagtgcaatggcacaatcttggctgactgcaacctctgcctcccgggttcaagtgattctcctccctcagcctcccgaatggctggaattacaggtgcctgccaccacgccgggctaatttttgtatttttagtagagacagggtttcgccatgttgaccaggctggtcttgaactcctgacctcgtgatctgcctgccttggcctcccaaagtgctaggattacaggcgcaagccaccgcgcccagcctgacttcatcctcaatacctcaataccttgaatgctgaattaagtcccaaatccttgtcaccagaggcccttcatggccgggcccctgcccatctctccagcctcccctccatcccttgcaccctacactccaagtctgcagaactgtttggaggtgcccagagtgtactaccctaccctaccacactgtgctgcttccttttcacaaacacctctgtattcgtttgctagagctgtcataacaaaataccacagcccgggtggtttaaacaacagaaagttgtttcttcccaattccagaggctagaagttcaagatcaaggtgttggcagggttggttccttcagaggcctctctccttgcttgtggatggcatcttctccctgcctcttcgcgtggtcatccctttgtgggtgtctctgtgggtgtctgtgccctaatcgcctcataaggacaccaatcctactggactggggtccaccctaatgacctcattttgacttaattacttctttagagacctatctccaaataaggtcctattctgaggttgtgggtattagacttcatgaataattttggggggaccataattcagcccataacgcttctccctctggctaaaaatgaatgtcattctcacatgcaaaatacattcaccccatcccaacagtttccaaatcttaactctttgcagcaccaacttttaagttcaaaatctcatctaaatctcatctaaacccagtatgggtgaggctcccagtatacttcttcctgaggcaaagtttctctccagctgtgaaactgaaaccggacaacaagctatgtacctccaagacctaggggtggggccagcatagaaagaaattggaaaggagaaaggggtcacgtgttagggtacttccatgtatgcatttttgaggttaactcaatggagagtagcctcccttagtgaacctggaagatgccacacgccatttaacgtccacttatcagggtgcccatttggaagcctcttcctcctgtgcttctccgtacgccacccagtatatctctccatctcagtgccataacactcaccacatccatctgatggctgactctcttccctgccagactacacacctcacgacttccagtacatgctctatgagtgactattacgcacataaaccccatgagaggggctttgttgttttgtacatgctgtgtcctcagagtctaaaacaagtctggtagatggcaggtaatcaacaaatatttgttgaatccgtgagtgaatacaaataaacacacacaccaaacgtgtatcatgtgcacattctggattctgattttccaggagtctgtgaatctatgcagtttcttcaaggagagtccaaggggacatcaacacactcctccttcccctcagtggccggataccagctgagcaaccgtcagatgtctccgggtctcccgatgactcactgaatgctttctttgggaggagtgggaggagaggatggctgacaaaaataactgcgggcacttgaagcggcatcaagcctctgtcggcgggggaacaacgggggcgcatctgaaggtttctcccaggcggggcgggcagctctctattcttcagcaccggaggttctcctatgtgtttagagaattagataaacgtagagtgaatggaataaaaccggcattgctcccaagcagtcagctgctcttgccatatgtgaaattctgtatcagctgtgaaggaaacacacaggaagggagcttagtgaacaccgttaaggtgatcattctgtgtgtctgtctttttttgttctttaaaaagggctttatgctttgtattttatctcatctgatgatcacatcaatcaggtcagaagggcactttcacggaagaaaaaggctcagagagaatcactgacttgctggagaggatcattagagcatggttctcaacatgtggtccaaggaccagcagtgtcaccaccacctgtgaacctggtagacacgcaaactctgggccctttccagatcagaaactctggggtggggcccgggagcccattgtacaagacctccaggtgattcaaatgcatagctgagtttgagaacccttggcttagagtcacacaggtaacaagttacagatcctgggtgagaacccaaggatgtccttggatactatacttcagtgagtgacttgcatgttagtagctgacaatatctctcaggacaatcccttgcaatattaatttacattttgcttttgcttctacttcagtttatgaagcccggcacagtccagttccggctacagctccagcttccctcccactcactgtgctggggccacactggccttctctctgttctttagacacagcatgcccttttctgctccaggacctttgcacatactgtttcctctgcccagaatgccatccctgctagcttgattcttctcactttaagtctcgaggcagtcatcctcttttcagagagaactttaggacatgcccatgatgctcacagatcgttctgtttagtcgcatcatagcactcgacacctcccgaagttaacttgtttgtttattttattttatttttggagacagagtttcactctgttgcccaggctggagtgcagtggcacgatctcggctcactgcaacctctgcccaagtagctgagactacaggcacacgccactacacctggctaattttattttattttatttttgtattttagtagagacggggtttcaccgtgttgcccaggctggtctcaaactcctgagctcaggcaatccactcgcctcccaaagtgctaggattacaggcatgagccactgcgcccggccaccttgtttgtttattagaaagtaaattccctgagagcagggtccttctggtcctatccaatattgtgtttcccaagttcaccacagtgcttggcatatagtagacactcaacaaacacttactgaaaaaataaaccatgaactagaggcaacttgaaagagggaaaaagcactttcctccattcttgaatcctgtaagaatggccagtctaggctggctctcctttggggaagggggcaggaagaaaaattaacagtttcttggttatcagggatgcctaatggaagctgcagttgccacagatggcaggggagggaagttaggcttagatgggaagagtgtggctgccttaagacttgcaaggggacagctctctctcggttttgttttttttggagacggagtcttgctctgtcacccaggctggagtacaatggcgcgatctcggctcaccacaacctccacctcccaggttcaagcgattctcctgcctcagcctcctgagtagctggtattacaggcatgcactaccacacccggataattttgtatttttagtagagacggggtttctccatgttggtcaggctggtctcgacctcctgacctcagatgatcggcccgcctcggcctcccaaagtgctaggattacaggcatgagccaccgcgcctggcctcggtcttttttttattgtggtgaaaaacatgtaagatgaaatctaccctcttaacaaatttgtaagtgtagagtacaggcttgttaactttagaactttctcatcttgtgtgaccgaaactccacatgcattgagcatcagctccccatctctcctccccaagccctggtaacaagctttcagctttcagcttctatgaggttttttttttttttttgctttagattccatataaatggaatcatgcagtatttgtccttgtgtgactggcttatttgacaacaaatgtcttcaaggtccattcatgctatagtatgtgtcagaatttttttcctttttaaggctgaatgatattcctttgtatgcatgaaccacactttctttgcccattcatctattaatgcactcttgggttgcttctgccttttgtctactgtgaatgatcttattatgaatgtggatatacaaatgtttcattgagactttgctttctattcttttgggtatatactcagaagtgggaatgctagatcatttgataattctatttttaattttttgaagagtctctgtttatctatttatgagacaagatcttgctctgttgcccaatggcttgatcatagctcaatgtagccttaaattcccaggctcaagcctcctcctacctcagatccccaggtagctgggactacaggtgtgtgccatcacgtctgactaattttttattttttgtaaagatagggtctcactgtgttgtccaagctggtcctgaacttctgggctcaagcaatcctcccgccttagcctcccaaagtgctgggattattggctgagccactgtgcccagcccatactgtttttatagtggctgggccatatcgcagtcttaccaatggtgcacaagggcttcgatttctccacatcctcatcaaccctcgttttatgatttttgttttgtttttcaataatggctatcctaacaggtatgaggtgatttctcattgtggtcttgatttgcatttccctggtgattagtgatgttgagtacattttcatgtgcttgttggccacttgtatatcttcttcggagaaatgtctgttaaaggtctttcctcatttttttttttttttttttttttttgagaggaagtttgactcttgttgcccaggctggagtgcagtggcgcgatctcggctcactgcaagctccgcctcccgggttcaagctattcctctgcctcagtctcctgagtacctgggactataggcacacaccaccacactgggcttattttttttgtatttcagaggagactgtgtttcaccctgctggccaggatggtcttgatcgcctgacttcgtgatctgcccgcctcagcctcccaaagtgctgggattacaggcgtgagccactgcgcccggccaggtctttcctcatttttaggttgggttgtttgtttttgtggctatctattaaattttcgatccaacttttgattctgccatttacagagcactgtatgtcaggtattgtgggaagcccttaacacacacaatctcattttatccttacaacagccttgaaacatagatacaataagaattcacatgttacagatgaggcatcaaagcacagacaggttaaactacatgcccaaggtcacatagctagtaagtgtccgagagggtcatcagaccagaccaatctgatcctagtccggatcataatctagaagccctcactgcatctcaccactgtgcaggttgatagggaggctggggcagggtcctgtagcaaatcacaagggtgtcttctctatagtccagtgtgctgggaagacaacaggttgggaggtaggatcctgggatctgctgatctcagtgctgctccgactggctggggagcttctggcacagtcacctcgtggcgcttggccttagtgagagcattgagtcaagggatgggatgatgttttgaaaaaatagtgtgtcagaaaggaagtactgctaggagtcccaaggctggtgcatacatcatgccggcgtcttccctcatctcagaacccagagcctgtctcctggctgggggctcacagagggtcctggctggtagaagtcttgcttttggtgtgttaaacacccacagagttggagcagagaggatggggagcctggtgctggcctccttgttgggactggcctctgctgtacaggggtcttcaggaggcagagggatggggtggaggggttatatgggtatagagagttgaggcttccaggccccactttgccatactaacccatcagactgcaggcaagttaagctccaggacatctgatcagcaccaattctttcccttccctggttccctctccgctttgccccgtctcactccacatgagtacaaccctaatggcacctcaggagaacacctgtctgccttggaggaggctcagcctgaatctgagcctgtctgctctctgagtccaaactaatgtttaaccaggaagtacatttctgttaggaagactcttcactaaagatgtggacatcgaagttcaggcagggcagagagatttgccagactggactgtcctgccatctagtggtgggataagaggattagctagcgtcccctccagctgtggctgccctggagagaacagcaatttttttggagggtaagagagggaagagtggtttggtaaatgcaccgtcattactttaaggcataatccatggcagtacgctcttagttgcttgagatatctaaccaactgttgggcaaaaagcagcataaattttggcacctgcgagaacactgtaagttttctctaaggggtcacctacaaatgccatcagaggtgggactttggaaatgtcgaagtttggaactcatatactcagaagtcactggttcttgctaacttatattgacacatcacagtagaggtggattctaaagattcactctaggccaggcacagtagttcacacctgtaatcctagcagtctgggaggccaaagtgggaggataacgtgagtccaggagtttgagaccagcctgagcaacatagtgacacctcctctgtactattaaataaaattagcttgatgtggtggcatgcacctgtagtcccagctacttagaagcctgggtgcttgagcccaggagttcaagatttcagtgagcagtgattgtgccactgcactccagctggggtaacagtgagagaccctgtcttaaaaaaaaaaattaattctagagatgtgttttctctgatttgatttattttgggaaacaagtagctctgaaactaaaaaatagttacagtgaagactctagaaattctgaaaatgattactgaaattgtcctactgtttccatttattgggagctgtattcctgaaattgatgcaataacggagatgtagtggagaagggaagctgggagaaggggaaagagaaagagctcaggctcctccagaaatcatcaccttcggcaataataataaaaagagtaagaatgacaactaactatcagtcaggagaggttaggttttgttatgacactatcccagataaacgatgccgaccgacactggtcaagatggtgaacacaggttttattcagcaatactatggcagcaaggaagagagaccagtgtggattgaactcaacttctccaaaacaaaaggctggagacttttaaaggtggggtgtgctcagggaaaggcactaaaggtgtgaatagggttaggccatgtcaggccacctgggtttgttgactgctgtctatctgaaggacacacacacttctcatgtctttgtgacggggcagtggtgcaggttggagcaaggtgcccacagttaggccctcagcctcccctacagactaggagagacagaattatctccctgaagccttgcattttaaagagaagactctcaggtcctggaggaaacagttttgggtggtagttttatatcccaaagagcaaagaaaggctttataattgcaagctttctaaagtgatggctctacagggagttgaggggtggtggtgcagagctctatctgcctatctcttggtattggctggaacaaacagtcaattctcctggcagccttgagctttctcgggaaggcctttattttaattttcaaaaatttttttgagacaaggtctcactctgttacccagcctgaagtgcagtggcatgatcatagctcactgaagcctcgacctcccggattcaagtgatcctcccacctcagtctcccaagcagctgagactaaagttgtgctgtgcatcaccacagccatctgattaattaatttttttttttttttgtagagataggctctccctatgttgcccaggctggtcttgaactcccggtctcaatggctcctcccacctcagcctcacaaagtgttcagattagaggtgtgagccaccatgcccggccatatgcaggcctttagctgggattagggtcatcctagagacagggccttatgcttctagaagccatgctagagttcagttgtctattagtgcagaaattaggatggagccattatatgctgggagttctgcagtttttatttgtttctgggaaaactttaaaaaattgttgaaaacatacatatcataaaatttatcattttaacaatttttaaatatacagttcagtggcattaagtgcattcacattgttgggcaaccaacaccaccctccaccttcagaatattttcatcttctccagctgaaactctacccctcaaataataactccccattcctctctcctgccagcccctggtaaataacattttactttctgtttttataaatttgattcctctatctaccttgtgtaagtggaattatacaatatttgtccttttgcaactggtttattgaactcagcattacgtcctcaagtttcattcttgtagcactttcttcagtaggctaagattccactatatgggctgggctcacgcctgtaatcccagaaccttgggaggctgaggtgggcgaattgcctgtggtcaggagtttgagaccagcctggccaacatggtgaaaccccaactctattaaaaatacaaaaattagccaggtgtggcggtgggcgcctgtagccccagctacttgggagactgaggcagaagaattgcttgaacccgggaggcggaggttgtgatgagccgagattgtgccactgcaaggagatatgacagtttcagatttgaccatgttgggatgattgggcacccaagtggctggttgtagagaaccgatctcaagaatgcagggaacccacacaggaagattagatgataaaaatgaccaacaaggtaatcatcagagggacagtgttataaggaaatacagactaggtagaataacagagaaggaaaaggtaaggaattaggccagaaaacaagctctcatcactctaagctttgattaatgggtcaaaaccctaatgagcatcttgcctttcagttgctttcccgattcttttgtgcattgcacactgctataaaaccattctttctagagtaccaatttcattcccagtcgcagggggtcatgcttgtaatcccagctacttgggaggccaaggcaggaggatcgtttgaggccaggggttagagaccagtgttggtaacttagtgagactctgtgtcttaaaaaaaaaaaaaaaaaaaagtgaaaaaaagatcgccatgtctttagctaaaacttaaagattttttagcataaaagtactatatgttgcataaagaaacagtcatggccgggcacggtggctcacgcctgtaatcccagcattttgggaggccaaggtgagtggatcacctgaggttgggaatttgaaaccatcctggccaacatggtgaaaccccatctctactaaaaaatacaaaaattagccaggcgtggtggcatgcgcctagtcccagctacttgggaggctgaggcaggacactcgcttgaaccctagaggtggggttgcagtgagccgcaattacgccactgcattccagcctgggcgacagagcgagactctgtctcaaaaaaaaagaaaaagaaagaaagaaagagtcatactacttgaatagacatccctccaaggcatacaaatggccaagaaacacatgaaaagatgcccaaagttattagtcattagagaaaatgcaaatcaaaaccacaatgacaaaccacttcacgcccacgaggatggctataataatttttttaaaacagtgcaaaataacaagtgttggcaaggttgttgagaaattggaactctcctgcattgctggtgagaatgtaaaatggtgcagccactgtggaaatcagtttggcatttccccagtaagttaagcatagttatatgtcccagcaattctacttgtaggtatgtacccaagagaattgaaaacaggtatccaaactaattttttttttttgagatagaatctcattctgtccaccaggctggagtacagtggcatgatcactgttcactgcagcctcgacctcctagtcttcttcttctttttttttttgagacagagtttcattcttgttgcccaggctggagtgcaatggcgcgatctcagctcgctacaacctccacctcccgggttcaagcgattctcctgcctcagccccccacgtagcttgggattacaggcatgcaccaccatgcccggctaattttgtatttttagtagagacgaggtttctccatgttggtcaggctggtctccaactcccaacctcaggcgatccgcccactttggcctcccaaagtgctgggattacaggcgcaacctccaagtcttaagctatccttccatctcatttccccaagtacttgggactacaggcaggtggcaccatttctggctaattaattttttttttttttgtagatacaagatcttgctatattgctaggactggtctcaaacttctgggctcaagcaatcctcctgcctcggcctcccagagtactgagattacagacatgagccaccatgccctgcctgaacaaaaatttgaatgtgaattttcatagcaacattattcatgatagccaaaaggtggaaaaaatccaaacgctcatgaacggatgaataggtaagtaaaacatgctgtattcatacaacggaatattattcagcaataaaaaggaatgaagtgctgatacatgtcacaacatggatgaagctaaaaaatgtgctaagagaattaagctggtcacaaaaagccacgtattatatgattccatttatatgagattcccagaatgggtaaatccatagcgacagaaagcagattaatggttgccaaggtctgggggaggggagagtagggagtgactctgtagtgtgtacgaggcttctttatggggtaatgaaaatgctgtgggactaagtagtggcaatgattgctcaatattgtgaatataccaaaaaccacttcatggtataccattaaaatagttaaagtggtgcattttatgctatatgtatgtaaacacacacacacacacacacacacacacacacacacaaagaaacacttataataggtttttttgggcagttgtcacctgatagatgatatcagaagaaattaacatcacagtatcatggaaactgggacattttcctattctggttgattgatttctgagcacagttttgattacaaaacatttcaaacatactgaaacctatagaaaataagacacccacacatctgtcacatagatgtagcagaggttaacattttgtcagatttgtttttggttaaaaaaatcgaacattacaaatacaaatttaatctgacacagatacacacacatataatagatgctaacaacaggattatttgtcatagtaaactaaacagctggggaaaacctaagcatccacgggtaggagacgggagtctgtgttccaagttgttaaataggtttccttaagtgggggtgacaagaagctgtgatggtgaaatcaccgagggacttttatctctgctttttttttttttttgagatggagtcttactctgtcacccaggctagagtgcagtggtgcaatcttggctcactgcaacctccgcctccaggtttcaagcaattctcctgcctcagcctcccaagtagctgggattacaggtgtccgccaccactcctggctaattttttgtatttttagtagagatggggtttctccatgctgtccaggctggtcttgaactcctgaccttaggtaatctgcctgcctcagcttcccaaagtgctgggattacgggcgtgaggcaccgcgcccggcctgtcactgttttgctttaaaaatttcagtgatcatccttgactataaactcccacttgcattggttttctagggctgcagcaacaaagtaccataaactgggagacttaaaacaatagaaattcttctctcactgtttggaagccggaagtctgaaatcaaggcatcagcagggttggttcttctggaggctccgagggagaggcgctccattcttcccttccagcttctggggctgccagcaacccttggtgtgccccaggtttgctccctggtctttgatcactgcttccatccttgcctggccttcttcctgcatgtcttcatagggtgttctcatctctgtgtgtctccgtccaagttcccctcatcttacaaagacactagccattggattagagcccaccctaattcagcaagacctcatcttaactggattacatctcaaagacctgatttccaagtaagatctgattcacaagtacggggatcaggactacaacatcatgtatctttttgggaggacacaattcaacccacaacaatcaggtacaatcaaaaacaataaagatacttccggtgattaaatggtaaaaaaaaaattagaaaataaagagaaaagagaacgtaagcaaagccaattcaaaggaagaaataaaaatggagaggagatgaaatggggagatgtcggtcacagcgtgcaaactgagttacaaaaggaaccagctctggatctcaggtgcagcaagggcagtgaggggtgtgttcattaatttgattctggtaatcatgacacaatgtataccaatcatcatgttgtacaccttgaatatatgcaaccttcatttgacaattaaatattttaaaattaaaaaattaaaaaaacaaggcacattctggacactaaaatcctgctccagtgggtaccattcttcctgaatccagctccttgattatccaggaatgccatgattacaaggtaaattttcctgcaaatttttttttgttaaactgatatgtgccgtttaaagtttctcaaactagtccttccttgctcgaaagtctcttgtacttaaaacactgggaggagagaggctatgggtaatgagaaaggggaggggaaaatatattaaaggtgagacagttctttctacattagatggactatcaggtgacgccatcccataggcaggtgggaaagacgggagtagagcctagaagaggccacaggaccaacaccgggagctgcccgcagagaattgaggactgaagtggccataaacgccaagctctgcaagggagtgaccacagagagaaaagagcagagggtggaccatgaaatcctcaggagaaccttggaaaggggaacagggaagaactgatgtgaagatgccagatggggggtggggacctgagctaggcaggtctccaaagtgagtggaggcagcagtgtcaggggaagggaagtccacaccacatcctacacacgcgatgtcaacaaagtcagagaagaggtgaggagccaaagaccctacaatgtcactgggttcagctgggaagttggtgttgattagaagagagtactttggcggactgagggaattagcgttgacaagtagaaagaactcctataatttgataaagactctgcttgaccaaactttagtcaggctcctgaaacttgtcctgggctcatctgtgcggttacttgtaaatctagttttagcaaagaacccggccaagtccgttcagccagtgccgccagcctctacgctctgatcacctggatatctgatcagattcctcactctccaccatctcccaggtaatgttgggtcaccctggactgtcttcagccagagtcccgttaggtgtgtttagcctgaatactccttacctgtaatgtttccttttagtaattttccacccactgactgccaccctgctccttggttataaactcccacttgcccaggcagtattcagagttgagcccaatctctgtctctcacccactccaagaccccgttgagcggtccctatgcccatccacatggtcctgaataaagtcttccttactgtgctttagcaagtgtcgttgaattattttttccttaacaaattcaatatgaaaaagaagactcaatagaaagatgggcaaagtatataaaacaacacctacaatagacttctttccagtagttacagtgaataaacaggagctataggaatccacatggataaatctgaaaaagacgagataagacaaattgcagaaagaaatgcacaatctggtacttaaagtttttaaattttcattttttacttaacaggtgaaatttcacatattatttgtatatacatgcacatataaaagtgtaaagacatttaaaaagtggttacacgtacagaaaaagacaagggaatgagattcaggcaggagaggttcataggggattttaattgtatctatcatgttttaaaaacattttacatttgattaaggatattagacatcataaaataagccagcctgctatttttggtatctaatgaaaatctctttcttggtcaggcattgtggctcacgcctgtaatcccagcactttgggaggccgaggcgggtggatcacttgaggccaggagtttgagactagcctggccaacatggcaaaaagtgaaaattgtattttttctcttcttggggaccttcagctgtaacagaagagagaagagctgacttctggaattaaccaaatgtgagaggtccaggtttagatgcatctgggaaggtggggggctgcgcagagggacactgtgtttaaatttgtcttgttacatctggctgacagcctggccaaagctacaacattcctgatcacacaggtccattgtgactgcattacggtctcattgcaatttccgcagccctgagggccggctggaattgccaccagggaagttagagaaactagaaggtgctttgttcctggggctggacttttctactggagttaatattcagaaactctggaaatgagactgaatcaaatttccaaatccaaatcaagttaattgtactccctattctcttttacaaattatcagcagcatgcattagagctgtcaaatctttacccacttgatggaaaagaccaacaaagctgctctttttgaacattgctgatttttatttgcttttactttttctagccataacaagagattttctcagaatgccttatacttggtaaaaagatttttacagacttacagatgtgcttttctcttagatgaagtgtgattggataaacagtgaactactcaattttatttcaattctccagcatgaagccattgaaaaatacaaaaattgcattttttaatttttttgagatggaatctcgccctgtcgcccaggctggagtggagtggcacgatctcggctcactgcaagctccgcctcccaggttcacgccattctcctgcctcagcctcccaagtagctgggactacaggcacccaccaccacgcttggctaattttttgtatttttagtagagacgggatttcaggatttcactgtgttaaccaggatggtcttgatctcttgacctcatgatccaccagccttggcctcccaaggtgctgggattacaggcgtgagccaccgcgcccagctgaaaatttcattttaaacattcccttaattttcttacaagtttaaatatctgaaacatgaaaagctgcaaatatctacattcattgtacatcataaatattttattactccttcgagctgccatttctatgatgtacataagaggaatccccggagcacagaaaatgatgagaaagtttaagccaagttcaacatgaaaatgattggcttattttcctttaaacctcatggcacccaagacgcagcttcatgcgcaccttgttattgttgctcacaaacccaccggtcactctgcttcccacttatcttctagagacttttgttcacaaaccccaagccttagcttcatgctccatgaagtcaatgtccacaggatgatagttccacttgccctgctgttctttgaacctcttatctccaccccccgccccccacccacccccacacacacacacacacacacacacacacactggcatccccatgcctcaccagcaccagcacctctacctctggaacattcaccccagacatctcctctcaccaccaccagtacgtcagctacttgctcgagaactcataatattcaaatccttttacccctgggagagctctgtcctgagtgcacatgttcctgttgccagaaaagagggtcccgatccagaccccaagagcaggttcttggatttcacgtaggaaagaattcagagtgaatcacagagcacggtgaaagaagcaagtttattggaaactaccctgttacagagtagggcatcctcagaaagcaggaggaggaatgcatcgtcctttgttagtgcttctacttgtaagaaacttcaaggaagccaggcgcagtggctcacacctgtaatcccagcactttgggagaccaaggcggatcacctgaggtcaggagttcgagaccaggctgggcaacatggtgaaactccatttctactaaaaatacaacaatatagccgggtgtggtggcgtgagcctgtagtcccagctactccggaggctgaggcagttgaatcgcttgaacctgggagatggaagttgcagtgagccgagatcatgccactgcactccagcctgggcaacagagcaagactctgtctcaaaaataaaaagaaactacaaggagctatgactaaacttgggacgtgcctacgtactcactaaaggtaggggctataggcattatcgattttacatgaccattataatccttcaacctaagcctgttcattggcattatctccaagtaaagagcgctgcattccggccgggcgcagtggctcacgcctgtaatcacaacgctttgggaggccgaggtgggcggatcatgaggtcaggagattgaaacatggtgaaaccctgtctctactaaaaatacaaaaaattagctgggcgtggtggcatgaacctgtagtcccagctactggggaggctgaggcaggagaatcgcttgaatccgggaggtggaggttgcagtgagctgagattgcgccactgcactccagcctgggcgacagagcaagactccatctcaaaaaacaaacaagcaaaaagagtgctgcattctgaggacatctggcaagcttgtccaacccatttgattttgttgttgtgttgttctgttttgttttattttgttttaggcttttagcagcctgaagccacggtttttagtttctgtctctagtgataagcggaaaagaatgaggaaggggctttactggcccaaccagaaacagaaactaagaacccatgactgggctgggagaggtggctcacgcctataatcccagtactttgggaggccaaggcgggcagatcatgaggtcaggagattgagaccagcctggccaatatggaaacccatctctaataaaaatacaaaaattagctgtgtgtggtggcgggcacctgtagtctcagttactctggaggctgaggcagaagaattgctcaaacccaggaggtggaggttgcagtgagccgagatcgtgccactgccctctagcctcggcaatagagcaagaccctgtgcaagacccaggctggagtgcagtggtgtgatcatggctcactgcagcctcaaactcctggctcaagggattctcctgcctcagcctttcaagtagctaggactacaagtgtaggcctgcatactcagctaatttttatttttctattttttttttgtagatatggggtcttgctgtgttacccaggctggtcatgaactcctggcctcaagggaccctcccaccttggcctcccaaagtgctgggattacagatgtgagccaccatgcctgccctaatcacattctttaaactgtgtatacttttactgattttttaaatctgtttattttaccagttactgacagaggtatgttatcatattatgattcaggatttacttttcctttcaattctgacagtttctgctttatatattttgagattaagttattgggtacattttaaaggtgcagttatgattatctagtggattaatgcttgtatcatattattcttcatttctagtaatgcttcttgccttaaaatgtattttgcatgatattaatatagcaacattaactttcgattagggtttgtgtggtataccttttctccatgctttcactttctactttttgtgccctgaaatttacaatgcatcttttataaacaaagtaagttttaaaaaattcagtctgacagtctttgatcttctcttatttatccatttatgtttaatataattacaaatgtgtttgggtttaagtctaccttcttgctatttgttttctatttgtcccaccttatctatgtttctttctctctccttattttccaccttttggaaattctccaaatgtttgtcattaaaggactgcttggatacactgtagaacaaccaaacaatatagtaatatgcaactgtaaaaaggaatgagaaatatctctgtgatccttaggatttatttttatgtgggaaaaacaagatggatggatgcgtgaatagtatgctacagtttaagagagaatggaagggatagaaatatatatgtacacatttgtttatgctaaaaagtggaagaataaaccataaaatttaaaagtgattagctacaggagagggagtgaactgggtagagggcataggaatagaagttgggtttctctaatgtactttgttttgtggattctactttgatagcataaaaaacttttcctagttttaaaaccaaaatatattaaagaaaaaacaatccataaaccttgaaagtacaatgaaacaaaggaacttgtgtgtattagtttcttgtggccactgtacaaagcaccacaaacttggtgtcttggaacactttctcagtttgggaggcaagaaatctgcaatcagtttcactgggccaaaatcaaaatgttgtcagggccatgctccctccaaaggctctagggtaaaatccattccttgcctcttccggtttctgattactggcatttcttggttaatgactgcatcactccaatatgtgcctctgtggtcacattatcatcttctcccctgttaaattttcttctgcctgtctcttataaggcatttgtaatttcatacagagctccccaggaaaaacaggataacctccccatctcaagatccctaattatgcacacctaaaatccattctgacattataaagtaacattcacaagttctaaggattaggacctggatatctttgggggccatcatatggtctactacactgtggagttggtgttataacacccagagaaaaattattccaagttactttaagtttcattgacttgactgtacatctctagtagggtatactctaaggacaaaaataatttttaaaaaatcttaaacttttccataataatggtggtggtactattataattgttctgaaatttttaaaaatgtgtgtattgtttgataaagtaaatgagtaattatattggcataactgataatatttgggtttccaacattggagaatagagatacagatataagactgatgaggttaagtaaaaatcctgttgcttgaatttgaattgggagtatcggtttgaactgtagctctatttgggagaggtctagacacatcactattcaacactgatgagtagcccttgcacctagattgtggtttgtaaataccatctcccaccaaaaggaaccagggcctcctgaagaaatcattaaatctaggtatggggaaagaagtgtgccagttgaacctcgtataccttatcatttcagaaaacaaagaagtattgacaactagggtgatgttaaaggcctcaggaatcaacctaaaaaggcttccacaggtcaaagacggaacaatttgagtatcaataggaataataactacaaggatttgaaacacacgtcacatgaatttgttatataacaacacttaagaagcaagcaaataaacaactaaataaacaaaacctcattggtcagtttgagtatcctagggaacaaattattaatttgaaagatgttaaataaaggaataaagcaagcatttattattgccagtgtgtgggtgcgcacccaaggcagcgcgcgacacattccgctgccgatctcccccttggggtgggaagatcttacaaactgcatgtctctcccacttaaattcgtagtcagccttaaataaacccggccgccttcaccacaacaccgccaccgagaccggtagggcctgcctcagcatccgccacgccttctcgtaccccggaagggtgcgtgcgcgctctcggagataggggtcttcagccgtgcgcgtgtggagcagggccacggcgcctgcgcagcggaggctgtggaccacatttcccaagaacactgcgttcctgggcccgcccagtgtcccagagtccctttcgaggcggaagctgggctcctccctgcgtctctttctgggccgtggagctgtccgctctgaaacctgaggaagtcgtagttcagggaggggtagctcttgcacctaggccgttaggaacgagttttaggttcgaatcccatcttatggaaggtggtattggtcccttgggtgtcccacccgtctcagccaaactgcgggccatttcccggggcgagcaaggggagttaccgcgccagtgggtggactcgccgcctctcggagtcgggaggaagtcgagctggggtgcagttacgagtctcagttaataatgaatagggtggccaatggtgggccaggcacagtggctcacgcctgtaatcccagcactttgggaggccgaggcgggcggatcacgaggttaggagataagagaccagcctggctaatatggtgaaacctcgtctttactaaaaataaaaaaattagctgggcatggtggcgggcgcctgtagtcccggctactcgggaggctgtggcaggagaatcgcttgaaccgaggaggcagaggttgcagtgagccgacatcgcgccactgcactccagcatggcgacaaagcgagactacgtctcaaacaaacaaacaaacaaacaaaaaaaaaaaacaaaaagaaaaggaaaaaaaagggtggccaatatagtgaaaccccctctctactaaaaatacaaaaattagctgggcgtggtggcgcgcgcctgtagtcccagctactcgggaggctgaggcagaagaatcgcttgaagccgggaggcaaaggttgcagtgacccgagattgcgctactgcactccagcctgggcgacagagcgaggttccgtctcgaaaaaaaaaacaacgaaaaggggactcacttcggagaagctgccctctctgcaaacttatttgagtaagggactgaagactgaagttagggagaggaaagggatacacgtctgttagtgcgagttgcgtgtcttgttagtgcgaactggaacccaagtttcctttgggaagactttggcgaaagagtacaggaacaccagccactccagaaagagaccgctcctcttgaacccgcccacttaactcctcccgcaggctctacgttcgaatgcctccaccctgattttagaaggttataggcgcacaatcaaggaaatgtcgacagagggcgtccttgctctaagcagcattgtccacctgcttcctgagcggggttcagtgattattctctgaacctggacttctggcgttgtgcctctatactccatttccctgcttcaaagctctcctaattgactttattttctgacactcccccactttaccccccaggagtgttgcttcttttatttctttgcctggatggtcgtttggcttagtaaatagacctagaccccaccccatggtgtagaagcagttggtgaacttctataaagggccagacagtacacattttaggctctgcgatctccttatggttgaaagttctactgttgtagcacaaaatcagccttggacagtaagcaaataggtgtggctgtgttccaacaaaacttcactgaaatttgaatttcactgtaattttcacgtgtcacgaaatattttaaccgtttaaaaatgtaaaaataatgtgtgtgtgtgtgcgcgcgcgtgttagcttgggccgccagctagcagtagtttgccaattcttggtagagaaagagagcagtctccacctaggtctgggaattcagggagagaggtgctggccaaaataacagttcatggcctgcttttctagatctgggagtgagtaggactactactagactctcatttgacctctcctttgggaatcgcagggtatatagtgcccactgattggtgggaattttgtcaaggtgggtgtgataatctggcttctttcccttcccagctctttatagtctttctttcttttttatcgttctctccctctctctctttagagatgtggtcttgctatgttgcccgggctgagtgcagtgactattcacaggccggatctagtgcactgcagtcttgaactcctggcttacagtcctgctggttctgagaggcaggggaagaaacggccaccatgctctgcagctaggtctcaggtaggtttgggccatctctcttctctggtttctaggcacatctcaactcaggatgcacctttccagggagaggtgcatcctgagttgaggtaagtattcatcctggttgcaagatgaatacttttcattcttccactacacagtcattttaaagttaagtttcatctatgatgggtattctgggtcctagaagagaggtggtacctgggtcagtccctttccagtctgcagtctaacacatacagattaaatgaatgtgaaaataaaaaaatgctttgtaattacaaagcactctgcaaatacaaatgttgcagtaaagaaaaaaagtatggttgacatctttctttattctagaaagtgcaaatctatcttttttgaatacttagcacttctctgaactactgtatcttgccagcactttgcacagtgcatattagaataacacattcagtcaatatttattgagtgcctacttgcctattatgcatctcttagtgcctttctggtttttatttttatttttatttttttgagactcagtctcactgtgtcaccccaggctggagtgcggtggcgtgatctcggctcactgcaacctcctcctcctgggttcaagtgattctcctgcctcagccttccgagtagctagcactacaggcacgtgtgccaccatgtccggctaattttttgtattttagtagagacggggtttcaccgtgttggccaggatggtctcgatctcctgacctcgtgatccgcccacctcggcctcccaaagtgctgggattacaggcgtgagccacggtgcctggccatgttctgcatttcacccaaccacagattggaaatattgagcagaaaaccctcaaaataatgcaatagaaaatgtaaaactatctacatggtatttacattgtattaggtattataagtaatctagagatgatttaaagtatttgggagaatgtacatcagttatatgcaaatactatgccatttttatatcagctacttgagcatccaaggattttggtatccatgggagtcctagaaccaatcctggaaccaataatgagggatgactctaatgtaaaatatagtgctcagcatgaatattccaggtatagtttaaaatcagtttacagtggagagcattacttttcaatttctggatgcagatcttattttgatatggcccaaaattgttcttcaagaaaaaacctctactcttgtaggcatgaaacagccaactttcttgtaagaccaataggactaaaatgattattggtgaataagagagtggctcctagctcccctgtcaaagttataataaatttagaaagaagaggtttggggatgaaaacaatttagttttaggttaaaccacataaggtacttatgagatagttctgagtgatcactgactatatggctttgaaacttgggatagatctgagtgaaaaattggtaggaggaggtgcatcctgaattgagatgttctcatttaaacatttgaatttaagaaactgtatgggagggggacctcttttggctttggagcctcccaccacccccgtctctgtacaagggaggtgcttatttcttccttctcccttctttctttcctcttcttgcctattaaactatctgccccttaaaaccactccacatatgtccatgttgttttatctaaaccagcatgaggaccaagaaccctggtgttcctccactcatcggagccgtatcattttggtgcattggccaggaaaggaaattcaatcatgagactggtgagtatggagcggatttcaactttatatctgttctttagtctcaaggctctcttccagctaccctgtcgccaaaactttctttctatctgtggtctctctgtgtgtctaatgtgcaggattctgtctgttagaaaagatcgtgaatcacggcatgcagtaactcaataagtgtctctctctctctctacgttttctctggcaagcacatggtatttctaagccacctagtagaaatcaggctgtaggcctcttctaagaatgggaagtttctgcttttaacagttaggagtaggatgtcttccatggccaaattttagtctcaatattgtcccactggcaggaaaacggccattcagttcctatgttcctttaagccatctattctggctcctactaagacagtgcttaattagtaaggggattttaagtccagaagttaaccggaaccattcttctatgggtaaatgctttagcatgggctataatggcaggatatagagttcaatctatcacatcccctcccttaaagggtctcttcccaattacatggtttttcttcaaatccattttttgggaggcacacaggccacccaagtctaggaggtcaaaggtaaataaaaggcagagaactgattgcttgggaacagcgtgactatggcccaaaactcagatcctctggtgccatggcttggagggtcacacctgcagtcatgggtggaacatttaaatgagtgctgggaatccaggaacaaaagagaaaatagttgggggacgcctcctactgctttcttctccatcctggatttcataccaaaaggaaggagactaaaaggacgcttttattctcacttctctttctagatgggtaacagaccatcttcaacatgcacttctcttgagtgtattttgaagcactaggactctttcgaccttgaaactttgaagaaaaagtggcttattttcttttgcagtcatatcaggcaggcccagggaaaacagtaccccaaaatttaaaaagtaactttcagggaagtcatctgagggtcccccttatttggggccccttcaagttcccttctcattgcaggacctttggcaagtaaagggagacttaggctggttttctgatgaccttaataagtatatggaagctttccaatatttaactcaggtatgtaacctctcatgaagggatgttatgttgctgctaaggcaaacccttactgtaggtaaaataagcagctctgcaagcagaagaaaattttggagataagtaatgtctcctatagaaggccaaaagggaaaagaaaaaaatagggaaggcaaaggggaaacaccattcccaataggaaaagaggcaatacctcctgacaaccctaattggaactcctttctgtggtgtttttccttgttttgcagtttaaaatggcttctcttttataatgttcttccaacatggaaaaggttaattttccaaaccttaaaatgtttggcatagagttgagctagggggaaggaaacccagcccagaagcctgatatgctggcaaaagggtaaaaatttcttaccagtcaggcttttggcttctctcttcctgtggaaaccggcaaaagggataataaagatcattgtttatgttttctttaaatttatagttaatgaaaaaggatttgtgaggttggtcttaagctgtaaacaatctgctcttctttgtatgtctttctgtgtggttctgttaaagaaaaggtatcttaggtcaggatgcaggcccagaaacccataagcctgctgttcaaaccagcccagcaaagtatccagtggcaaacttggctacaggcctccatcttgtttcatgtcatgggaacataatctgtaaccatgtggcaatactttgtttttgtctccgccattttacaatggtggctgtcttcttgtgctaaatcagataagccagtttgtcagtctgggctgtgtcagctgatccatcaagggcagggtttacaaaacatcttaagcactgatcataacagccgtttagggagggtcaaaatcttgtagcctccaattgcatggctcttgggccatggtttctaatcctgtagctagtttcttggtctggtccccaggcaaaagggaagtatatcttgagaagcagctgctatcttctttgttttagactataaactgtaaaccaagctcctccccaacttgattcagcctatgcccggggatgggcaaggacagtttggggactggaaacaaaatggagttgtttgggtgagatctcttccactgtctcagtcacaattttgcagtgacagtttcaaaagctgcctgtccgggtggatcacgaggtcaggagttcaagaccagcctagtcaacatgacgaaaccctgtctctactaaaaaaacaaaaattagccaggcgtggtggcatgcacctgtagtcctggctactcaggaagctgaggcagaggaattgcttgaacccaggaggcagaggttgcagtgagccaagatcatgctactgcactccagcctgggtgacagagcaagactctgtctcagcaaaaaaaaaaaaaaaaaaaaaaagctgcctgtcactcctttaaaaataccttttacactcctggttaagtcataacctaattaaagctctttagttttacctgtgaggttacttattgtaaagttcaaaagccaaaaatcttaactgcttggcatggctaaggtcaagtaacaaaggatttagaagaattttcttaaagagtgctcagcttaattaaaagtggaaaatcaagttataggtatattaaaaggcctttatgttttttcttttcttgaatcttgtttttctggaaaaaggctcatctcagccgactgaattatttttctccattttttgtcttactactcttaatgcatgtataaaaggccctaagataacttctggtagcatgggactcctcaggaaacacagaggaggcgccacagaccccgttttgggaaaaaaccctctgttttcctcatgaaaccccaggaattaaaagcaaataattccctctcaaaatcaaaggctctgttctgttttgcattgtgttatctgatggttttgagttttgggggtatcagaaattacttcgcatttttacaagaaagctttggtgtgtaataatcaagtagaaaatacactgtaagggatggctaatagtagttataaatcagggatgctcttggccacctggaagataaggaaacatcctcaccctgcactgggagatgagactcccatcagggatgggctaattacaaaataagccaattggctttgggctgccttgcaatgcaatgcatggtagaagcactacaccgtcctctcccatagtatctatatggtcttttcataaattaagcattaaaataaaagcatagcaaggaggtcttaagacactaatctgccccttagtaaaagggttataaaaggtttgtaaagatttcaccttggccgggtgcggtggctcacacctgtaaccccagcactttgggaggccgaggcgggcagatcacctgaggtcgggagttcgagaccaggctgacaaacatggagaagccccgtttctactaaaaatacaaaattagccaggggtggtggcacatgcctgtaatcccagctacttgggaggctgaggcaggagaatcgcttgaacctgggaggcggaggttgcagtgagctgagatcatgcccttgcactctagcctgtgcaacaagaatgaaactccatctcaaaaaaaaaagaaaaaaaaagatttcacctcatggtcaaattggttaggatttgatggaataatctataaggtttcgtgtaaacaaattggggttaacattaataaactaatgcaagggtaaaattttgctttgaacaagattttcatttcataataaaggctaatgaaaggattttgccttttgagtcatcattttggcaaaataatttatggcaatctggaaattgtccttcctgatacctaactttttgaatggtttagaggggccctgaaacattcagaaaagaggtaaacaggattatttgacatgtttagtcacatgagattgccaaaatgatgtccaatcttatttaagttatagtttggtgaataatactaatatatgtttcagaattgtatgggatttctaagattctaatgtctaagtatatgctatcaatcataattaagggtaaagttattgtaaaccatgaagataaataaacttctttgtcagtcatgtttttaactatcctgaaaattttgtcattcacagacaattgttgtcctgctttgttccttttcaaaaaatggtttataatcaagctctattaaggagttcaacaggtgttctcaaatgcaggtttttaatagctttaaagattgtaacattggaatagagagagaatgtatgggactcacaaagaactaatatgttcataaatatcaagcaaaacaagagttaagtaaatggactgcactcagaaagttaaagcagagtttttaactttgcttggaatattgctgatccttgttttgtttttcagagtcaagaaaagttttaaactatttatggcctttaataattgagtaaggtatactcctgtgaacaaaatttggagcatatttatttgtctctgcctggttcctctagaatttggagactagctgtactcttaacttaacggcaatatagctctttgcatcagtgcaataagaatccatttttctttgtcaacaggacacattggaaaaactggttattttaaccaaggcttgagggtgtgtttccttttaaggaatcaagcttgacatgcagagcaaataaaagccccttggggagaactggcctcataccttgtctgcacagtccctgcacaagattcctaacctgtggtcagtaaagagtgtcactttctaataggtctgggagctccgagtttatcttggggcctcaagaggagaggatcacccaactcacaggtatttgaggatacaaacccatggctgggcttggctttaaaaggtcttatctgagattccttgtagaacagtttcatcgaagccaatccaaaaggcctgtgtagaaataacctttcttgctgcactttatgcaaacaatcaggccatgtataggactaaagtttattctacagacaacacacacgggcctatcataatttgtttttatcaaaaatgaggactggagagaaaaactgtgctccaaagcttatcatacatttctccaaaacttactatacatttctcattaaatcctagtctcatcaattgtttttaagctttttgcctacatattatactaactctgcttattcctgtgaatcaagtggtaatcccctacagtttggaagaaataaaaagggatgggtaatgtaaaaatctgaatcaatatgctagttctgggcaattatcctgcaaattctgccagttaatgaaagtgagtatgatgcccattaactcaggtttttttttttttttgtttgggaaaataaaaccaaggcttcatagaccaccaaaggaaaattctgtatcttggcaagtaaaattttacatggaagttatctactacatcacacttgtggaagttgctatactcactctgctatttgcaagagggttatacgtggtagcaccttctaactgacatattggacagagtttccattgctgttgtattttgctcaattattatccttatagcagggataatagttactgacaaaaaggaagcatgaaagttttactatcactgagtctgctagcactttttattgggtttagtaatgattaacacctctagtagaggaaaatctacaggtacttaagaatgaaatcaaaattattaacaggctcagggaaaatgccggctccagccctggatggctacaatccctctttaatgaattccaatcttctttatggaattggtcagcccctttatcaagccctctcctgcttatatgtcttgtattgatatttggaccctgtatactcagtaccataactcgaactgtttcttctcgcctcaaagcagtcaaactccaaatggtactgcaaactgaaccacatatggacacgccattctcccgaggacccttaagttgaccctaggaggagccctcactgctgttccccatttgacgccccttttcagcaggaagtagccagaaagagtcgtcgcccaaaaccccctaacagcagatagtgtgatatcaccacagggaggaatgtggtaggagttattaagaaattattttaggcagagaggcaaaggggtccttgggaagttttagttttttaaagcatctccagaaaagtttcttgtaaagccccgactcttacagtcaggccatcaacctttgatatgcaaatgcaggccattagaaactgggtccacccaacatgtcaattcccacagccttcttgcccttgccccacatgttcctggcaacatggccacccccacctatccctacgtgtgtagaacatcgtggcgccccatatttgcatatgggtgggagggccagctcttcctctggctatttgaagacatgcctagtcaaaccaatcccctgagccctatgcaaatcaaacactgccttctccagcctctgtatatatacctagctggtatccgtggcaggtggggaccttctctttcggctttggagccccctctcctgtctctgtacaggtgagctgcttctttcttccttctcccttccttctagccccttcttgcctattaaactctctgctccttaaaacaaaaaacaaaacaaacaacaaaaaagaaactctatgggaaagaagacaaaaacagatttaaaaaactttcagtgctctaatctcataaaaatacataattctataaaattgtaggtacatactctttgtactcagaatttccatttaacattattttacaagaagaactcaactaagtgctggagctatgcggttccaatccttattctgtcattatatgacatatggcctcaagcatgacatttcagcatcatgggcttcactttccccattcatacacagtgcagggctcgatgctgtttacacacacgcatttgtacatatcactgtagtgcacatgcttgccatttttaatggttatagtgttctaaggggctaataattatgaaagatagagccatggggagaacagaaacagaggagtaagaatacattttcgggcacatgcaagtgaactgacaccagaagacaaagaatgaaacataacagccttaaagttttagagaccaaataaaggtttagtaagaaaaactagtacttagatttgcatgaaacagatccttaggattaatatttagatcttaccagaaatctgccttaagagatgtgatgggaaaggagggctattagcttataaacaccgtaagttatagacatataatagttaaaacacaacgtattaggtatacatctagttgctttcttaattgccctctacttaacccacttggcagattaactgacaagttctattcccttgtaaatttcctgatggcattgtcacaggccttttgcagctaatttgctgctttctagcatacataacatggaagtgttctctccaatttaggtgcatgcttaacaagatttagttgtttgcacccgaaagtttatcccagttatgtaattatatccctcattacacagatattaggtaactgatggcatgagtgaagagttgtctttatgaaaaccaacttgaatggttggaaagaattgccagtgacactccgggagcagtgagaatccctagtgcccagatcttggtttctaaatagctacctattaaaaggagccagggattcttggaaaaaggtttcattccaggcctggggcattgaaaatgcaaggccaacttgagatatcttgtgttagaaggcaatcaagtgtccaaagactagagagtgaatgtcaaaaggacataagagatacttgaagggctccacctggccaaatttgggacaatctgaacatcagaaacaatgatcataaatgacttaacacattgaatcatgtgttatcactgcagatgaaagcatcaaactctttactggtaattaaactcctacactggtaattaaggtaaaataattgctgactgtgcctctagtgcattcctagttgatgagggaacattatacaagaatgccactcaacaagtgtagagtgatagaattagaaaattgtcattttgcaaacattgatgagacaatggattcaggcaacgatcaccgttggttactttttaccaggtaaaaagttgttggcaatcaaaatatccatgtgctgccagtgtcagtccacagattaattgcaataggaaaaactacctttatattgggaagatctggtgacctcaaatgagtgatccattgataatgagtcaacctgatattaatgagacttttgatatgatgcactatgaaatacatctgtgaggtgttatcattaaaaatgtttaaacaacccaatcaagccttttgccctaacttctaatttatggaaactacagggggtaccggaacaacccacatgtaaataatcagttgaatcctgaacatgagacatttttcaagacaactgacctgctctcttaaagaggaaaaactgtccgggcgcggtggttcacgcctgtaatgccagtactttgggaggctgaggcgggtggatcacgaggtcaggatatcgagacaagcctggctaacacagtgaaaccccatctctactaaaaaaatacaaagaaattagccgggcgtggtggcgggtgtctgtagtcccagctactcgggaggctgaggcaggagaatggcgtgaacctgggaggcggaccttgcagtgagccgagattgcaccactgcactctggcctgggtgacagagtgagactccgtctcaaaaaaaaggaaaaaccaaagtggggactgttctagatagatgaaacagataatcaaatactatgtgtgaaaactgactggatcaacagaggaaatttaaacacagactaagtcttcagatattagggaattactatttgttttttttttaaaggtatgtaaatgtattgtggttatgtaaaagaccatccttatttttgtaagatgcatgctgaagtatttagagatgaaatgtcatgtctgtaagttactttccaatgtttggttaaaaaaaatacggcagaatgttagtttttaaatttaggtgggtatatagttaattttatgatttttaaaactttctatatatttgaaaactcataataaaaagttctggaaaataaggctatttgctaaaaactgttgaataatttgcgggtcagacaactgtaaaagtgggaaaaatacacaaagatctagggttctccactattactagtctgttattttataagggcatcaattgcctctgtttatcagtggaagactttataaatgcattatttacataaaacatacaaaggcaggaaataacagagtaatgcaaaggaaggcgctatggactgtcacatgccacatgctcaaccaagggaaataagtgctgtgtgagggatgaagcagcatcaaaaaaataagattttcaaacaactgttattttaaaaaacagctatataagcacagtttgagtattctgcaacctgtactttgtgcaggatgatactatgaaatcaaggttaactaatgtaagggaaatggaaatcaagttttttaaagaaaacactcaataatatagcctttaggatactagcatcctgggtctttccttcagtacctgtttgtaggatggttttataaacagtaatgtccaaaggaagttgcatggttaatacatgcttaaattgatatttatagcaccagaattgataccaatttcccctcatttagctcaggaaaacttcctgtacaaagatgtcccaggaaacctgattcacgatttttaagcagttcccaagtaaatgttatttgttgaacatttctttgatatatgcacaaaaatatttttcgttataccaattttcactccatgccagtcaattctactttattactgaaatctaatttatataatttattcattaattcaaccatgtattgaccatgcactattatgcaagggactggagaaacaagtaagagcacaatgaaatctcagttctcagaatatggccttatattctggtagtggaatgctgtaaatatgaaatacaatagtatttttatctatttctatttgcatttctgccagttttccttttgagacccacaaacccagttatcattgtttaatgattactgcatcaatgctttttccaattaaattttttcctgacatgttaagagtaatctctgttttacttgtatgtatgaaggagtgtcaggcttccaattattctttaaaaatcggtcattttgtttttagtttcttctaataaccaggctgaattcttttttatttagccactctcatttcataggcaaagcaagtccaattacatttcatgttatagcaattatctatgtatgttttcctcactccattaaaatttcaccttttccccgacccacattctgcagtgaattcagatctattttccatttttttctcacattatttatatagctacactatcacttccacttccttctcttgggatataggtagcatttggcaacccattttagcaggttgcttatgctcaacccatgacaaaatatcacatcctcactttctcatcactctagaaatctttctgttgtgtaaaccacctgtgattttcagcactgtaacaagcttgagaggatccaattaggaagtttgggacctgagcatagtagacactcaagaaacgtgtttcagtggaagaaatgaactttccatagtaaaacagtcacagagaaacctaaagtataaatttaggagtcaggtgaaaaaaatgggaactgtatactttatacctacttttttccttcaggatgaccttgaatgtcaaaacctagtgaaatcaaggctaatgtgtattgaaaattcatttaagcttgaggcatttaatttttgcctgtttaactaaatctctacacatctaatgttatatacacattagtttctatcataacatatctttcattaagcttctctttaatatttccatatctgagggaaggtgtaaccagtggtcacatagaaatctttaagatacttccaactgtttttttttcaaacctactggctccatatggcagttatggcataacaggagaaggggaagtaaaacagggaagggagtcctttacatattttaaggcttcaaagctgggaataaaaggcctgaaagcagcttactcttttctgtaattttaagatcactctctagtgtgaaatctctatttgatggacaccttcctaagttacactcataaggcctcattaggatgtacagttgacccttgaacaacacatttgaactgtacagatccatttatactggaattttttttttcaactgaacagagtttgaaagcacattattcagggatgggaaacctgcatagatgtagggcttttcatatacacaggttccaccaggctgaccgtgcaacttgagtatgggtagattttcgtatacatgggtggtcctggaaccaatcccccgagtataccaaaggataagtgtacttgaaatagagagttgatgagttatgtttttgaatacccttcacagggtttctttctgtaatgaattaaaatcatatcaaattaaggttaagaagtcaagtttccttcttaaatttcacattaaatctaaataggttatatccataccactacttctgatacttctgctgagtatctaacatattgcacttcttcagacttcttctgaatgttctgacacatagaatgcacaaaacaaaattgaaacaaagttgtaaaaccgaattgaagtttcccttatccattaattacgatgtttggcacctgtatgaacacgttgatgctgaataaggtttgtactctgggtgaaggttttaccacatatacgacatgcatagggtttctctcctgtgtgaattctctggtgttgaataaggcatgttctctggctaaaatccttatcacattcattacatttatagggtctctctccagtatgagttctctgatgttgattaagtgatgaggaataaatgaaagctttcccacattcattacatttatagggtttttctccagtatgaatcctttgatgctgagtaagatttgcgccttgtctatatgctttcccacatatattgcatttaaagggtttttctccattatgaatcctctgatgttgagtaaggtgcacactctggctgaatgctttcccacacacactgcatttatatggtttctctccagtatgtgttctatgatgttgagtaagatttgcactctggctgaaggctttcccacatatattacatatataggatttctctccagtgtgagtggtttgatgttgaataagggttgaggaatgagcaaaggcttttccacattcattacatttataacacttctctccagaatgaattctctgatgtcgaataaggtaagtactctgactaaacactttccaacattcattgcatttatatggtttcttcccagtatgtattttttgatgctgaagaaggtgtgtactctgactgaaagtcttcccacattcattgcatatataaggtttttctccagtatgaactctctgatgattaatcagtgatgaactatgactgaaggttttaccacattccaagcatttatatggtttctctccagtatgtgtcctttgatggatggtaaggtgtgcacgctgactgaagtctttcccacagtcatcacacttatagggtttctctccagtatgaattctctgatgtatagtaaggtgtgcacgctggctgaaggctttaccacactggtggcattcatatggtttttctccagtgtgcattctctgatgtgcaataagggatgagatatgcctaaactctttcccacattcttcacattcatacgatttctctttggcatgggtactttggtgtttcaggagggatgggtatttcctaaattttttcccacacacattacacttgtaaggcttctctccaggaagtattttcctatgtacaataccatatgagacatgattgaaggttgccctgccttcattatacacagaagttttattatctaattgggtatcaaactgtacaattaggtttgaatgcttttcaaaattatttctatatatatcatatttactaagacattcttctgtaggatcatattcttgtgaaaggactgacttcaaactgaaacctctttcatcagtgtgaattttccagaagccaccttttcctcgcctctctagtctatcatcgtagtcatatgagtcttctaatttgatggtatgggtttcttcctttgtgagtttagacatatcctccactggagtacatgcttgggctttagtttcccattctgaaataaaaaatatattaaaaaatcttcatttatttggagaaaggaaactgccaaaatagaaacaaaagaataaacatagataaaatgcccaaagacaacagctctgaaaacctcatcatcatggtctttaaaacttgggaaaggagacaaagagggcaaaaaaagggagactaagttgttgaaaacagacaggttcttcatattcaacatggacacagagggaataaaacagattaagtcaggtgacagagctaagagaagtcaaaacagtgataacactgtgtgggataacttgggatggcctcatggattaatttatgtaatgtgttcataaagtagacatgctgactctcatcactctctcttccaatctgctccacacaatcccacataatattcctaaagcaatttcactgagtgctttctatgctcaaatatctctagtaaatctcccatggcctaaaacaatggttctcaaggcagtcctcccaatagcagcataagcatcactatcatctagaaatgtgttaacattattgggtctcacctggacatactgaatcagaaactctggcagtagagctgagtaatctgttttattaaacccagcagttttgctacataccaaagtttaaggactagtggcttaaagtataaaagttaaaaagtttaaaatacctccacttggcactcagtcccaaaataattcagccctttctattctattgtctcctactacaactcatgttcagcttaatttagttatccactacttttttttttttttttttgagacagactctgtgccatcttggctcactgcaacctctgcctcccaggttcaagtgattcttgtgcctcagactcccgagtaactgggattacaggcaggaaccaccatgcccagctaatatttctatttttaatagagacatggtttcaccatgttggccaggctggcctcaaactcctggcctcaggtgatccgcctgcctcagcctctcaaagtgttagggttacagatatgagccgccacacctggcctaaagttatccactacttcttcataatcttctctagatgccatgctaatcctagactctaggccttcttttacgatgccttctccacctattaaaaaagatgtttatagtccagctcatatttctctctacaatgcttctttgaatttaaaatacagattagaggccaagctctgtggcttactcctgtaatcccagcactttgggaggccaaggtgggtggatcacttcaggtcaggagtttgagagcagcctggccatcatggcaaaacgctgtctctactaaaaatataaaaatttagacagatgtggtggtgtgcacctgtagtcccagctacctgggaggctgaggcatgagaattgcttgaacccagtaggcggaggttgcagtgagccatgatcgccccactgcactctagcctggatgacagagcaagatcctgtctccaaaaaaataaaataaaacacagattaggttgaattatgtaggaaattgcctttttttataggtcaaaatggctgaatgtcagcaaccttatatggttcaacccaatatagtattgggctcatgacagaatttggctttatatgagtacagtcatggatttcttaacaatgaggatacgttctgagaaatgtggtgttggtcgacttcatcattgtgtgagcatcatagagtatacttatatgaacctagatgatatatatgtatatatatttttttccttttttaaatatggaaagctaaatgtaccagcactattactgatatcaatcacttcccctacttgatctgcaatacaaatattaagtgcttatgcatcaggcttctatatatgctccattgttgtcttatgggaccactgtcatacatgcagtttgttgttgaccaaaacatcattatgcagcacatgactgtaattcacaattctgtacatttcttatatttccaacctagatgcaaattctggaaatagcttatccttctttcacatttcgtttagaaaatggcccaagactctggatatggtggcgactcaactgaaatggtaaaataaatgacattaacatttaaaaaggagaactcagatgaaagcatacacagatgtgcatgcatacacataaccaaacacacacacacacacacacacacacacacacacacacaccccaaaccaaaccaaaaaggttgaccctcaatctaacctggctgtaataaggcagccaaatatgtatttgttggtgcctattattacgtttctcgtataattacttaacacaaaatttaagttacaacctctttctcctttgaaaccaggtgggaaacatataacttgcaaatatcaagaattacataatgtaatttaatcaaatatggaatttataatatagcaaaaatggtactaaatacttcagaaactttctaagaggcagatcatagtataatacctttacaaatatatccattcaattgagtaatatgcagtaattgaaaatgacagctacatcatcagtaagagactagttattaatagaataagggataacagaatattgataactgataggtaggtctagtttaaggactagtggcaggacacattaagtgaaaaaaaaagcaggtgtataaaaaaatgtagagcaagatcctagctgtgtaaagatatgctatttgtgttacagacagacacagacacacacacacacacacacacacacaaaatctaaggggagaaggtcctggtcatgactgaggggagagggacacttaatatttgcttccttgtactccttgaatttacaaattactttttttacttttattcaaatacaaaatcacagtttacctaagaaaatgtttaggagtaatgttaaatgaaaaaagagtatcataacaagcatgaaaacacatcagaagtggaaaaagattaccaaaatgctaataatgatattataagttttctggtttctaattttcagtaaatttgctatattacttttgttgctatttagtactagtaagtagttatattccactccagtaggtgtagcaaaataaaaagtaataaaaaagaaaaatagaaaatagttatattacttttatgaaagaaaaaaatttataaaccaactttctcaagctaggatttgttattcccctccccagaagaaaatgagaatgtggatggactatacaagtaggtgtgtatatacacaaaaaagagatgagatgataccagaagttgagttcaacttctatgcaatcagtatcagtctatgacagattgtacatacaactgaaaagtactaaagttataattaacaaacttaaagtgacaaggctgaatagtgatcatgaataaattgctactataaaagcactttttttttttttgagatggagtttcgcttttgttgcccaggctggagtgcaatggcgcgatctcggctcaccacaacgtctgcctcccaagttcaagcgattctcttgcctcagcctcccgagtagctgagattacaggcatgtgccaccacgcctggctaattttgtatttttagtagagacagggtttctccatgttggtcaggctggtctcgaactcctgacctcaggtgatcgcccgcctcagcctcccaaagtgctgagattacaggcatgagctactgcacccgaccgataaacgcacattttaaacaaattagtttactaaaacttctgaaacagatcattaagcagggtttaaatatgtgtttatcactaaaaccagaaaggattggttagaagtgttatctgttggttaataaggacaaacagtggtataatatttctaaacagaggagattaatgttgactcaggtaatcaaggaaagcttcagtggaggaagtgtgatttgaattgaacctcaaagaatggcaaagtactgtataaagaacaataaaccataaaatataataaagaactataaaagatctgagacagtaatggccatcaaaccaatactactattctgtttgttaattaccaaagtttccatttcctgaagtgtgactaacctacttcctgaagtaccctaaccaaaggtagattcaacttactatatctctgagctggcaagaaagcaaaatcctcacaggccaaaaattaagtacaagcaggaaggcaagaagtcagtaatagttgaagttgactgcctgagacagctcctcaatcatgtttgatgaccttaaacttccattttgagggtacaagggactctggggctagaagacaaaggctggggcccagccaaggagaggaggctgacaggagtcccttgaacagaggactacacactatgtaagaacaggctaggctagaaaaacaaaaccccaaaacctcacctctaaaagatgaaaaaaggaactgtctttctcagtcttggtgctctttggagggagaaaaatcccccctctccaaatgcataactatacattgccctttcttgagtattcagagcccaaatttgtgctctctgatgatctaaaaaactcctcatgttgagaagttaaagtgacttcagactgcaagtatctcccagaagactatcctggctctaatccaggcttatttccattacactatgtatgttttctcagtgcctagagtgtgcagaatttgttccccagagaatttagtgtgctgtaggtgtattttgtattttgccaactaaggcatataaggccataaattatagagaagaattagcttttaaagtttatgacccttaaaatacctaatgaccaaagttagttttttaaaaaagtgaaacaattcactctaaggtagcatatctttttttttttctttgagacagtcttactctgtcacccagtgggagtgcagtggtgtgatcttggctcactgcagccttgctctcccgggatcaagttatcctctcacttcagcctccctggtagctgggactacagtcatgcatcaccacaaccagttaattaaaaaaaatttttttagtagagacaggtctcactatgttgcccagggtggtctcaaattcctgagttcaagtgatctgcctgcctcagcctctcaaagtgctggggttacaggtgtgagccactgtgcctggccatatcatatttgtcattattgtttaattcattgttgtatactagcatccatattggtggacatacaagaagtcagtgtcttagatttaaaaaatggaatgtctgggtgctatggctcacacctgtagtctcagcactggaggccaaggcaggtggatcacttgagcccagaaattgagaccagtctgggaaacatggcaagaccctgcctctgcaaaaaatacaaaaattatctgggcgtggtggcacacacctgtagtcctacctactcaggaggctgaggaggaaggatcacttgaatgcaggagatggaggttgcagtgagccatgatcacaccattgcactccagcttgggtgacagagtgagactctgtctcaacaacagcaataaaataaaataaaataataaaataaaataaaaaatggaataaaagcaagatgcaagaatatacatagtatacttctttcatatacaaaagaagataatatattaataatttatttttgcaaagagaaacatgggaaggatacatcagaaaccaatgatcatggttacctatagggagtaggtgggaagagagcagaaggaaaggaaatgtatacctttctatatagtttttgagttctcagccatgttactgtttttgcatactcaaaaatgtaaattaaaaataattttaaaaagcaaaaaaacactatccttagtggtatatattctaaggacaaaaaggacttcaaagaaatcttgaactttctagactgtttgttatactaatgtgaatgtgaaactatttttgtgtgtaacatatgatatagcaaataagtaaatatactgatgttgttggaaaccaggttattcactgtataagaaaggagatacaaaatggaatatgggaatataaaaaatggaatatccttgtggtgtcagatttgaattggagtttaagtatgaactcctgacttaaaagaactaacacacacacacacacacacacacacacacacacacttcctagctctatccactgaacagaagcaatgatacccataaacagtgaatacgcttatggcccagatcttggtttctaagtaccattccctactaaaatgaatcagggttccttagagaaatcccaagtctaaggtgagcataaggtgagcctaaagaacatctggctgtgccagaaagcaaggaaatggttgaagacaaattgggacatgtcaaaaagatgctggacttttgtttgatgctagagtgcccaaatttgggacaattgagcatcaaaaacacaaaataaaatgtaaaaactggaattaatggactgataataaatacatacacatccatatatatatatatatttttcttttttctgagatggagtctttctctgttgcccaggctggagtgcagtggcacaaccttggctcactgcaatctccacctcccgagttcaagcgattcttctgcctcagcctcccaagtagctaggactacaggcacgtgccaccacacccagctaatttttgtattattattatttttagtagagacagggttttaccatgttggacaggctggtctcaaactcccgacctcaagtgatccacctaccttggcctcctaaagtgctgggattacaggagtaagccaccatgcctggccgactaataatatattgaatttttaaaatttccattagtcaacagtggtgtatatatatatatatatatatatggggtgggggagggagagctcttcttttttttttgaggtggagtctagctctgttgcccaggctggagtgcagtggcacaatcttggctcactgcaacccccgcctcccgggttcaagtgattctcctgcctcagcctcccgagtagctgggattacaggcacccaccaccacgcccagctaatttttgtattttcagtagagacagagtttcactgtgttggccaggctggtcttgaactcctgacttcgtgatccgcccaccttggcctcccaaagtgctgggattacaagcgcgagccaccgtacccggctgaaagggctattctttaatgaagaatggtattaatcatttagaaaagatgactgcattagaaaatcaccattttggctgggcgtggtggctcacacctgtaatcccagcactttgggaggccgaggcgggtggatcacaaggtcaggagattgagaccatcttggttaacatggtgaaaccccgtctctactaaaaatacaaaaaattagctgggtgtagtggcgggtgcctgtcgtcccagctacttgggaggctgaggcaggagaatggcgtgaacgtggaaggtggagcttgtagtgagccaaggtccccccactgcactccaacctgagcaacagaccgagactccgtctcaaaaaaaaaagaaagaaaatcaccattttgcagctgggcacggtggctcacgcctgtaatctcagcactttgggaggccaaggcgggtggatcacctgaggtcaggagtttgagaccagcctggccaacatggtgacaccgtctctactaaaaatacaaaaactagccgggtgtggtggcacatgcctctaatcccagctactgtggaagctgaggcaggagaattgcttgaactcaggaggcagaggttgcagtgagaggagatcacgccactgcactccaccctgggcgacaagagtgaaactccatctcaaaaacaacaacaaaaaagaaaatcaccattttgcaaccagcaatataataacgcaaagatcatcaaatggatgctaaaaattttaagtaaaagattatcaaggaatagtcatgtgacctcaaagtatcactccacagatgacttattaatcacaaagaatgcacctttaaaaaggacagatcctgtacacaccaccttaaccaaactgagcatcaccaatgatgagatgaattaccattatgtacctcctgaagaaatgcaatggaagatacacatcacctttcaaatatccttggcaaaatgtttaaactgactaatctttaggaaacaatgaggcaaatctaaactgtaggtcattaaaaaaactggcttggaacctttaaaaaatgtcaatatcatgaaagactttttttaaaaaagaaaaaaggctgggcaacatttctctgttaaaagggactaaagataggagacatgcaagtagaacacgtgattcctgactggattctgtactggggagaaaaatatctataaaggatgtttttaggacagttgggaaaatctgaatatttgactatacatttgatgacactattatataaatgttaattatctagagtgagagaatggtatcatgcttatgtagaagaatgttcacgttcttaggaggtatttaggggttgtcttgatgtctataactaactgtaaaacggctcagtgcaaaaacctttgtatagagatatagcagaagtggctaaatgatgataattagtgattcccagtagacagtacataagtgatgaatgtaatgtgcctgtgtaggtttaaaatcttttaaaatcaagttattgtggaggaataagcaaggaatgagaatgaaaaagtccatgaataaggaacaagttcaataataaaaatatgatgcagatataaaaaaagaaatgaggaagctctttacatactcatttggaaggcttttcaagatatacttttaagttaaaaaagcaaggtacaaaacagtatgtattgtatgctaccattcacattaaaaatggacaaaaactatttttatattgactttatatgcaaaaaacccaaagcaaaataaacatctcaaataactgtttattgccacgcttttatcctggagacaacagttgttcaaactttattacctgacttctacttatgtggaactttattacagacttctacaggaaaacagtggttcattgacatgctgttatgacagcggtcacatgctggggagatgtaggaactgggtgaatgtggtattcaggtggacatttatatatatttatatattttttttgctttatatacttttaaacattttgaatcttgtgaatatattatctttttaaataattagaaaataaaaaagaaagggatgatttagaaaagtgaaggcagggggatgtagggatttgtcagtgaacagaataaaagaaactcaaaaagaagaaggtttaacatttaaatttttagggggcattcatacatgtttaaatctagaggaaggggaaagtggcacaatgaaagccctagacaaagctcttaagagatgggacctagaggtcatgtagaaggataaaatgagaagagacacgggaaaagtgtgttaacagtgatgttaggaagctcttcctgaagaggcctctgtaaggaagcaatgccaaacagctcagtgttcttcacaggctagaatgcctttgcaaaaagtgacctggtcatatttaaaatgcatttctcaccacatttaggatatagattcttaaatacaaagaagctcatgcgctttttgtttctcacctggactagggccttctaaaatttcttttatcaccatccatggttcttccaatatgggaatcacagttggtctgtacactgtaagtcctgttcaggaggaatataaagaattttatcctggagataaatggttgctcaaagttttattaccagacttctacctatctgggagaacagacctctgtaggaaaacaatagttcatggacatgatctaataagagaattaggctgttgattgttatcctttcagagacaggataacaatttcctgccactgaagaggatatgtgaaggaagaaacattcccttagagtagcaaaggctgggcaaggcagcatcaggtggcagcactatgaagctgtgcatcagttgccaatgttctctcacttaagaacctttcatttggaaaacgggagtaaaacagtcactttcgtgcttgaatgagataagaacatttatttctggaccccatttttagccaagcatgtctgaggaccaacccatttttaatgggaacaggctcggaggaggagggatgcagatgatccttacccagagaaaccatgttccaatagttctgtaacgtcacagtcttgtataattccttctgcacaggacgcattaactcccagtcctcctgggtgatgtctacagccacatctttgaatgtcatcgattcctaaaatatcaaatgtaacttaactcagttcaagaactaatggcaaaggggacactgataacactgggtatatgtatggtgggggactgtcacagaattttaagctttagtaggatcctagaagttgtctagtcaaaaccctcccctgacatatggacagccctacagcatctctccatgaccctaaacggaagtttgaaaatagatcagaatttattttcacttagcactcatgcatgcattggtggcagctccattttaaacagaaaaggtttatcattactatttttaaaagagacagagtctcgctctgttgcctgtgctggactagtgcatgcattgctggcagctccatttttaaaaggaaaaggtttattatcattatttttaaaagagacagggtcttgcctggtcacctggactggagtgcgatggtacaatcattgttcactgcagcctcaaactcctgggcagaagtgatcctctcacctcaccctcctgagtagctaggactacaggcacacaccaccacatctggctaatttttaatttttttttgtagagatggggttttgctatgccacccaggctggtctcaaactcctgaactcaagcgatccttcacctcagctccccaaagtgttgggattacaggagtgatccaccaggcctgacttgagttttaaattttaaacacagatgacacagttgaatggttttgcttttcaagctgtgctttaagaataaatccaacatgttataattaaaatgttaagatatttttatgtgttctatggttaaattcagtctttctttttaaaaatataacagataccaataatcacagtgttgaactgctgcactgttaaatacatttcacaatctggtaaggttagtgcttttcttgtttgctccttttgttaaaaatatagtattatcttacatgtttcttttttctctttttttatttgagaaagagtcttgctctgtcgcccaggctggagtgcagtggcctcctgagtagctgggattacaggtgcacgccaccatgcccagctaatttttgtatttttagtagagacagggttttgccatgttggccaggctggtctccaaactcctgacctcaggtgatgcagctgccttggcctcccaaagtgataggatgacaggtgtgagccactgcgcctggccacgtgtttattttttcatataattgtcagtatctttaaaaaagtcatattggaggccaggcgcagtggctcatacctgtaatcccagcactttgggaagccaaggcaggaggatcactttgaggccagaagtttaagaccagcctgggcacatagtgagatcccatctcttaaaaaatcttttcttttaaatcatactgggatttaaaaattgtattaagtttataacttagggagaactgatgactttataatattcaaggtttctttcatgttctacaaaatattagacatgaaagtactgcaatatttatattatgcttagttttagatattttaaatttttttcgggggtgtgatactggaggcatttttttcattttatcatttatctcatttttatatgtatatatgtagatatatatataagtatatatatgtaagtgattgatttttgcatgtcattttctgtagtcattttatccaatttttctattagtgtttctaacactttttcccttgattttgttaggctttccaggtaaatgttcacactatcaatgaataatcattttaacttggttaccaaaagctttccaatttcagaaaaaccagttatatttttacagtaaatctttctcttaaggtatcttgagttactattctttaaaataatatagactcatggccgggcgcggtggctcacacatgtaatcccagcactttgggaggccaacacgggtggatcacctgaggtcaggagttcaagaccagcatgagcaacatggcgaaaccctgtctctactaaaaatacaaaaattagccaggcatggtggcatgcacctgtaaccccagctactccagaggctgtggcatgagaatcacttgaacccaggaggtggaggctgccgtggaccaagatcgcaccactgcactccagcctgggcaacagagtgcgactctgtctcaaaaaatatatataaattcatgaccaacagtaatatgacagaatgcatggcctttaactacttgttaatgaggaaaaataatagtaacaatcatctattaattgcttaactgtaatccaggctaactacaagtctcataatatttaatactcacaacctaagaggtaaattctatttatgagagtagaataactcaggctaagagaggttaagtatcttgtcccaaattgcagttccaatggtagagccgggaaacaaaacctaaatccatctggctgtggaggtcaatctcgtattctctatgtgatattgctgacaaagtcaaagtaaggaaagacatatcaagggaaggcaatggaagcaccttttctttatagtacattcacctaccttaacagaccaagataacataggagagaaactggggcttaagtccttgatagagcttctgggggcacagtagttatagggccaggtcagaaaatgtcctcacacactaagaaggcattttaaaatcagaaaagacagtcacactcactttggtcaccaagtcatttagccatcctgtctggaaagcatgttttcctctggggtcttcctctggggtatcttgggaaagggtagagttttgaggagctagagaagagaaagaggtcatgagggagattagtcctttctgaatagcctaggaaacccctcaccaaatagatgcctacactttcttaaatcgagaagtaagaaggaaatcaaaaacagcactcctacttcaaagcatcagaggaaagggccaatgacttgtcctaagacatcaaaacagacttcaaaaacaagctcgctctaaaaatcttaaagagtatgaacaaaattcacattttaactaaatccttatgtgatattaattttgtgagttatctcttaataagggaatgttctctagaccctttcttccttttttggaagtattttattgtaaaattcaattcacaaagcaaatgatttattagtagaatggtgcaaacctctgaaggtactttctgagggctcacacagtggtaatttggttgcgtctggtcattatttcaagacgtttttcttgggggtttagataatgtgtgtttgctcccaagcaatctggaaggagaacaccatgcaggatggagctcatgttaaagccttgttctcactcactaacctttgttctccccagtttctttctttttaaaaaatgcatcctggacctctcagtgctctccctgatttctttaaaggagctgctcagatgtgctagttgtcttctttaaccacccagggattcctcccctctctgctctatgattctcaccttcctcttctagaatctgagtcaaatcctccaccagagtcactgcttcctcgctgctctctggatactgggactttacccaagtcctaacctcaccaggcaggatggtcaggaattgctccagcaccagcagctccaaaatttgttcctttgagtgaatctcaggtctcagccacttaaggcagagctctcggagttgactcaatgcctttcgaggaccagccaggtctgggtatggaaaattcctaaaattctgtcgacaggtctcagtgtcacgcaagaatcttgaagtaaggatttccttctcaacattgtagggtccactctgagccttgtctgacttccaccttagaaggatttgagaacgtgaagaactgttcatcctcttgcttgaggctaacattgctacagacaggagagtcaatctggcaatatcctttatttctccagtagtgagccaactgcttgaagtctcatgctagagtcacaaggacactatatcaaaggctgctgcagccgagggcagaacagaatcaaggtagagttagcagccttagtgacaaattctgagcccagaacttgcagggatggataagagaccctgaaacacaagcatggaccacaaggtcaagaatccctggtgtactctactatacatatacacacacagaaacagactcgcagtgtgcatagatgaacacacataagctttaccttgtcttcctcccctatatccttagacttgtaagggaactgccatctgcttggggttggtgggggatggagctgctattaaaaaggtagtgtcagaggcaatgactcgaatctaagccaaacaacagattaaacctctaacctgttgtaacaaaaattaaacatttttatagagaaaatagtttcattattttagtcactgatgttacagaagctgtaatgactgaacggactctcaacaataacaaagtgaatctgttacttggaagaaactaggagaatttcttcttaatacagtgctcaaggttcccaagggaactgtcaggggaaagggcgagccatttatctgcgttgcatgttaatgccagccgattctagcctttcactatcagagggttgggaagaccagcgggttggactggaaaagagtgaagaggttggtgtgacttcaagtcctttaagtgcttctataggagacagttctttagggatatattcgaaaccaggattctcgaaggaaaccttagaaccggcctgatctggaggagaaccgacaccacctctccccaggctccagctccgagccctgctgaggcacagtcgtgccaccaaagacaactgtttacaaggccctgcggaggtgatgcgacagccttgccttgcctcctgtcgcctccccttcccggccaagtccctctgcctcttactcctcttcagccgcagggtcgaggtcgagggcagcgggggagtcggggaccgtgcgacgcgcaacgctgggactgggcccacagcagcctccaccccgtctttgccctcccgcaagccacgagcacgggagcccgcgcgtggacgggctcgggctgtcactgatcgcgcggacactcgcgcgctgcgcccggacatcaatacctgtcgctgggacccggccgacgggcagccggagcggccctaaggccacaggcaacaatggcgacgctggcacaggcgcctgcgtggcgggctcagtcccgagcggcagcggatcctcgggctccgccacttcccttccccgcaaagcacagagtgtcccggccaggagctgcacgttccagcccggtcctgagaagcccggcccagaaaccccggcgcctctgcttagccgcgacctcgcctcggcgtcactgcgcatgtgcgccagaggaacgctgcgcgcccgcagagccaatcggagcccaagctgccgcctccccctcccgcgcctctggccctggacctgtctccatggcaacctcctccacccatcgctctgacttgcttgtcagcctgcgaggttccgaagggaacttcaaagtttccccgggcagacgcaggtctggtagacgtcttggaggccagggaggtgccagtagctggaggagcgccgggagttgaagccccgcgccaactacgcagagaaaactgggcgccagatttcctagaggaagaatgggcagggaagatgtgggtctaaaggcagaaagacttaatgtgcggtttcgggctttactgtgcatacatactaactgtgaaaggttttcacttcctcctcaggaatttgattctgagactctcagattgggggaaaaaaacccatgttctttctttctttcttttttttcttttgagacggagtctcgctctgtcgcccaggctggagtgcaatggtgcgagctcggctcactgcaacctccgcctcctgggttcaagtgattctcctgtgttcaagtgattctcacttgaacttcctgggttcagcctcccgagtagctgttatttctaagagacacaaaacaaaaatacataaaacactggaaaaataaaagcatagaaaaacatattcaaggtgttcccgttatctactgttctattaacaaaccaccccaaaacttagtggttttgaagaacaatcaccgtattatgctcataaatttcatggtgaggaatttgaaaggggaactgagtgggtgggcctttgcctcattatgtctgtagcctctgttgggatgatttgatggctgggagggcccgcttccaagatggcttttccactcacatgtctactgcttgggaggagatgggctaaaagatgaactcggcttgtgtttgaccagagtgcctcaatgtggtctctccagcataaaggactgagggcagctggacttgttacatggtggctctgggctccaagagtgagcattccagtgaacaagagagaagcgccatggccaattataacatggccttggaagtcacctaacaccaattctgtcagactcttggtcaaagcaatcacaagcctacagagaatcaaatggaggcagaatcctgtgagggtggaggaggactgtcaaagactcttaatatcaccacaccaggaaaattttaacaaaaagaaagttggaccgggcgcggtggctcacgcctgtaattccagcactttgggaggcccaggcaggtagatcacctgaggtcaggagtttgagaccagcctggccaacatggtgaaactccgtctctactaaaagaacaaaaattagcctggtgtggtggcgcacgcctgtaatcccagctactcaagaggctgaggcaggagaatcacttgaacctgggaagcggaggttgcaatgagctgagattttgccactgcactccatgtactccagcctgggcgacacgagcaagactccatctcaaaaaaaaaaaaaaacaaacttggggagtgtgatggtcttttgatgtgtcaacttggctaggctacagtctcttgctatttaagtaaacacgaatctaggtgttgctgtaaaggcattttgtagatgagattgaagcccataaacccagttggactaagtagcatgggagattatcctagataatttgggtgggcctgattcaatcagttaaaagctttcaaaaaagaaccgaagtttccctgatggagaagaaactccatcagcgtaccacagcttccagcctgcccttcctgatggggtgctcttatggactttggactcacctggtcaccccctcaatcgagtaagccaactctttgccacaagtatcttaaatatctactggttccgcttttttgattgaaccctgactgatacaagtaataattctaatatctgataagctagaatttgagaagattaaaagggaataaataagagtgcttgatggaaaagatatatttatcataaatatacagcatgtccctaacactaaggcctcaaaacatacaaagcaatagctgacatacctgtagggaggaaaacataaaccaacaaccaaagctggaaacttaatacgccctatagtgcacactgtggtgctgccaggatcctccttcagggttgaggcatccatcccagcagctgccgggtgagtggctgctgatggctcacagcaaaatacttccttgggagttgtcctaactgcagggggctgcctctcacaagtcacgtcttctccccgggggaagtccatatccaaagactgctcagtgcaggcctcaaagacctggccccctgtcttcaacttgcagcctctataaagggccatcttggcttaagagttccctgtgagaccaactgaggcctctgttgcagtcatacagcatttaaacctattactctgtccagttatccttatatcactcctgtacaggcattttttctagagaacactacccagtaattaccttgtatgcaattctccatctcagaatctatttatagggaatctgccctacaccagttggtaccagcagttgttccaagaacgcaaactctaaaatggaatttttttctttttgaggtggggtcttgctctgtcgcacaggctggagtgtagtggtgcaatctcagcttactgaaacctttgcctcccgggttcaggcaattctctctgcctcagcctcctgagtagctgggattacaggcacccaccaccacacccggctaatttttgtattttttagtagacactgggtttcgccatgttgtccaggctggtcttgaactcctgacctcaggtgatctgcctgccttggcctcccaaagtgctgggattacaggcattagccataaaatggaattttgaaactgtgttacctgccacctagctgacaatgagggagggccctatgacttgtgattggcagagtagtgataatgatagcatatgtcaggttgtagcaaagtaattgttaaaattgtcagtggtgttgaactggggtggaatgttgacagaagggaacgcactggtgggtgctatatctcagatctttataacactgggggaagtggtaattctagagatgatggaattgaatggctattaccaggagctattgacaatgacggtgattagtgacaaattaattgaaaatgtgagcgtcagaagacttctttgaagcctgacagcaaaacagctgagaatcaggccctaacttcagctaagtttgaattctaaatcccagcaagtttgctatgccaaggtcaggatcctgctgggaaggagtagaactctgagatttgggatggggacattttgatttgtgcatgcaaacaccttcaaacaccaatcactctgaatttctcaggcttgctaaagtggcccactcctccaagtctaaagctagggctctgccttgcttgaagatgatgcagactgaggcctctacattgcaatacaacccgtgccccctcaggatctacctaccctttcctctccctaccccatccactagaccaataactagaattaagtcaccaaaaaaacccaacaggggaaattctgggcatgataagagaggaaaagaaccatcctctgaagttactacaggccctagtttatatgtatctgtaggaaccaggacagtatgtatgagactggaccctgaggatgctggatcaagaaggtaaaacatatattagagtaccagagagtttattgaaaaggagcacattcctggccaggcacagtggctcatgcctgtaatccaagcactttgggaggctgaggcaggcggctcacctgaggtcaggagttcgagaccagcctggccagcatggtgaaaccctgtctctagtagaaatacaaaaaattagccaggcgtggtggcaggtgcctgtaatctcagcgactcaggaggctgaggcaggagaatcgcttgaacccgggaggtgcaggttgcagtgagccgagattgcactgttgtactccagccggggcaacaagagcgaggttctgtctcaaaaaaaaaaaaaaaaaaaaaaaaaaaaaagaagaaaaagaaaagaaaaagaaaaaagaaagaaagaaagcacactcctgtgatacgggacttaaacactctggcaaggatgctaggagatggggattagagaaatttagagaaatacatggctcatgttaagcagaaaatgtcagaattgcttgacaaaaggtaaaataagaagttaaaaggttcagggaactgggcatactagaataggtagagtatgtaaggctgaaataccagctgtctatgtttcatcagaaagtctggaagatcatctgctgcgataaagaatgtgctagagagaggcaccagcatcattgagaaactctgtggtagctgtcctctgcaggctgaggctgacagtaggggatttgttacaagactgggcctccctgaggatggctccagaaataaggtgagctcaattcacataatgagcagtaagattaaagtggaagatggggagagggaaaggggaagaggggctttatcttcagagaactttcgaggagattaatagaacatagtgtctctaaagacaagaaatatgggcaaacaacaggggaagtaatcagtttatacggtcaagtgaaataaaggatggataatcaagaaactgaggctaatataatgtaatgatcactgccattttcaaacccagaacccatgactgaagaagccaaatcttcagaagtcaggaccctatctcaccaccatgaatatatgcgataatgattttcccagccccctcccacccaaagggacctatggccatttactcaggtatacaggaaaaagggagtccccagaagcttcaaggctgctggacaaagtttctgagttggccgggcgtggtggctcatgcctgtaatcccagcactttgagaggccaaggcaggcagatcacgaggtcaggagatcgagaccatcctggctaacaaggtgaaaccccgtctctattaaaaaaacaaaaaaattaaccaggtgtggtggcgggcgcctgtagtcccagctacctgggaggctgaggcaggagagtggtgtgaacccgggaggcagagcttgcaatgagccgagattgggccactgcactccagcctgggcgacagagcgagactctgtctcaaaaaaaaaaaaaaaagaaaaaggttctgagttgacattgatacttagggaccttaggcaacatgatggcctctatgttaaaatggagaagtgtggcagccaggtagtccatgaaagtctgtctcatggcaggcccacaggattcattgccccattcagtggtaatttccaaagaccttgattgtataactggaatggatgtacttactgttggcaaaccaaattagttccttggcctatagggtaagagctaccaaaaaggccaagtggaatactctgaaactacttccctaccccttccttggccaagacataagtcaaaaagtgtcacttccagagggaatggcagagattcatgcctctcttaatgacctaaaaggtacagggtggcagtcctcattgtatccccacttgatttaacagtcaggcccttcccaaacccatatggattatgaggatgacagtggattattataaaagattgaacaagaatttgctccaattgttttgctagaacagactgagacatccacaattacatggcatccaggctttgctctggcaagtgtgttcatctgccaggtgagcaagacatggcaggtaagtcggaggccttggtaaaagacaagcactacagagggtggagatggatcctacacaatttcaggggcctactacagcagtaacattttaggggcaagacagcaatggtctccaatacagagggtggattattgtgtttcacattcctacctctttttttttttttttgagactgagtctcactttgtcacccaggctggagtgcaatggcatgatctcagctcactgcaacctctgcctcctgggttcaagcgattctcctgtctcagcctcccgagtagctgggactacaggtgtgtgccaccatgcccgctaatttttttgtatttttggtagagacagggtttcactgtgttagccaggatggtctcgaactcctgacctcgtgatccacccaccttggccccccaaagtcctgggactacaggcatgagccaccatgcctggcctacactcctacctcttaacaaggaagcacaatccttgataagaccttttgggtttcaaaggcagaacattctaacttgagcaagaatcatgacatggaatgctgtcagctctgagtggggcacagagcaggaaaaggctaggcagcaggtccaggctgtagttcaagcagtacttccacctgggccatatgacccagcagctgttatagtagtagaggtatctgggctgcaaaagacaccatgtggagtttatggcaagccccaccatgtgaatcacaatatagacccctcggattatagaacaggtcttgtcatcttcagcagagaattacatgccattcaaagatcagctcctagcatgacactgggtaaagaacttgaccatggaacatcatgtgaccttgaccagacctgtttatcatgagctaggttccatcggatgctttaagtcatgaggtcaagcaagtctagcagtaattcataagtaaaatggaagtggtgtatgtgagtttgggcatgttttaatataggtgttattattatttaagtatagtaagtccaatagatcagaagatgactggcattgaaaagatagtttgtaatacagatcccagcagaagggggtattccatgccatggggatctccacgaagaagcactgggttggtcaggaggcagagggtggggagttgtggccaagagcatttattgtggtttccatgggaaggaatgatgaggcatggtaagtggattcagaattggctagtttgaataatttttttttttttttgagactgagtcttgctctgtcacccaggctggagtacagtggcacaatctcagctcactgcaacctctgcctccttggttcaagacattctcctgcctcagcctccccagtagctgggattacaggcacgcaccaccacgcccagctaatttttgtatttttagtagagacaagagtttcaccatgttggccaggctggtctcgaactcctgaccttgtgatctgcctgacttggcctcccaaagtattgggattacaggtgtgagccaccacgcctggccagtttgaataattttagtgtgccctggggcataagtctgtgcacagttgtctgttacttaggtacaatgtgcgtggagtgaagaaaaagtgggagagaggagtaattctttttatttttttggtgctggagtgattagaatagggggatagtggcccagagataagaaggtgcctgcgggtgtgggctctggactggttggtttgcatttgaaaagtgcactcacagacaaattgttaatgatctctaggaactgactaaccctggtaagggcagtccctcagcaagtcttcagatgtcaaagcatcagaatacataaaataaaagacatggttaacacagggcacaagcaagaccaaagtggataagctgcacaggcagatggctcagccttttatggcatgataacatgacaccttccctcagtgcacacctatgattgtgggggaaccagctaatggaggaagaaaaagtccaaccctggttcatggatgagtttgctcaatttgtgggtaccagctgaaaatgtgggtaccagctcctatatcatagccctatttaagagtggccttgaaagaaactgatgagagaatgtccttgcaatggacagagctggtgaacacctggacgtttattttatgtagaaagagaagtggacagaagtaaggatacacacgaaaaaagatggctggcttggatggttggtcaagggacttagaagatggaaagactggaggcaaggaggtctgggggaaaatccaagtggatagagccacactagggggcatgaagtgtgtcttagtctgttttgtgctgctataacagaaaatcgcagagtgcctaatttataatgaacagaactttactgactcacggttctagaggcttggaagtccaatatcaagaagccagcatctggtgagggccttcttgctgcatcattccatgtcagaagcacaaagagggggagaaagggagtaaaaggggctgaacttcccctttgataacaaacccacattcatgataacagcattaatccattcactctgctctcaagtctaatcacttctcattaggcctcacctcccaacactattgatactggggattaattttccaacatcatgctttctgggggacacattcaaaccatggcagggtgtgacagtctttgtgtcatatgttaatgttcaccagagaggatccactacagaagaagcatgaaactaccaagtagacgaaagacttgtccagttgtcatcatccattctctgccattagctactccagtgctggcacagtgcatgatagagtacccatggaagcaggcatggaggctgtgcatgggtggatgtccatatgctcccattctccaaggctgatctaactattgatgctttgaacacccaacctactagcaagagaacaatgccaaatgcctggtgcagtataatcactggaggagcccatcaagctcggtagcaagttaattacataggccactttccactctggaaggatcagagatggatcttgactggaaaagacacatgtttgggattcaagtttatctgtcctatttgcaaaatcttggagagcagaactctctaagagttccaacccagggttccaggtagcattcctgttatctggagggtttcaaaagtccaggaatggagattcctaaacaagagaaagaccatgatttgagttccagttctgctacatgctcctcatatgttctcaaatgaatgatttaaccactgccccacctctgttttcttcccttttttaatttaaaatttttatttttaatttgacaaatcataattgtatatattttatggggtacaaaatgatgctttgatatatgtatacattgtgaaatgattatatcaagctcattaacatataccttatctcacatatttatcattttttgtgtgtggtggaaatatttaaaatatattattttaacaacttgaaatatataagatgttattattgtctatggtcactgtgttgcacaacagatcttgtaaacttatttctcctgtctaactgaaactttgtaccctttagtcaacatctccccattctccacacacccccaccaccagcaactggaagccaccattctactctctacttctatatgtttggcttttttatattccacaaataagcaagttcatgcagtatttgtctttctgtgcctgccttatttcacttaatgtaatgtcctccaggttcatccatgtcgttgcaaaggatataatttccttctttcaaatggatgaatagtattccattgtgtatatataccactttttttttttttttttttttatggagtctcactctgtcgccaggctgaagtgcagtggcatcatctcagctcactgcaacctccacctcccaggttcaagcgattcttctgtctcagcctcccaagtagctgggactacaggcgcatgccaccatgcccagctaatttttgtatttttagtacagatggggtttcaccatgttggccagtatggtctcaatctcttcaccttctgattcgcccgccttggcctcccaaagtggagggattacaggtgtgagcgaccgcgcctggccaccacattttctttatccatttatttgttgatgaacgctaaggttgattccctatcttggctataatgaataatgcttcaatgaccatgggaatgcagatatctcttcaacgtgctaatttcaattcttttgtatgcatacccagaaatgaaattgctggatcatatgctaattctagttttggttttttgaggaacctccatactgttttctataatggctgtactaatttacattcccaccaacagtgtacaagggtttctttttcttcacatcctcaccaacatttgctatcttttggctttttgatcatcgccattctaacaggtatgagatgatatctcattgtgaatttaatttgcattttcttgatgattaatgacattgagtatattttcctaaatctgttggtcattgatgtatcttcttttgagaaatgtctgttcatgtcctttgcccatttttaagtttttttttttcttgctattgagttgtttgagttacttatacattttggatactaaccccttatcagatgtatcgtttgcaaatactttctcccactcggtgggttgtctcttcactctgttaattttttcctttgctgtgccgagctttttagtttgatgtaatccaatttgtctgtttttgcttttgttgtctgtactttctgggtcatagccaaaaaaaaatcattgccaggccaatgtcatggaacttttcttctatgttttcttctagtagctttacagctttaggtcttacatttaagtctttaatccactttgagttgatttttgattatggtataagataaggagacccccattttctaaactgtaaatgaagagagaaatattgtccatgctgcctaatctcacaggtgtcttaggaagatcaaatgggattctgaaatcaagcagttatgtttcagagagtaacagagttgtaaaaccattgttttgccaccattacagtaaagacagaccaggcaataatcatctatggatgggaaacattagtgaggtaggaggaaattttgttgcagagcagaatgttttcatgggcttaaagtgtttctccacagacagcttattagttacagggagggaaacagtgattaaataacctagaaatcagagaaaaccttggttggttgatcaaaattgatattaacagtatgagactgtctttgtattgttataaagtaatttataaagaaaagagatttatttggctcacagttctgcaggctgtacaataagcgtggtgccaacatctgcttctggtgaggacctcaggctgatttcacaaatggcggaggggaaaggaagctaacatgtgcagagatcatatggccagagaggaagtgagagagagagaggaggtgtcaggctctcttaaaaaccagctgttggccgggcgcggtggctcacgcctgtaatcccagcactttgggaggccgaggcgggtggatcacaaggtcaggagatcgagaccatcctggctaaaacggtgaaaccccgtctctactaaaaaatacaaaaaactagccgggcgtggtggcgggcgcctgtagtcccagctactcgggaggctgaggcaggagaatggcgtgaacccgggaggtggagcttgcagtgagccaagatcgcaccactatactccagcctgggcgacagagcgagactctgtctcaaacaaaacaaaacaaaacaaaacaaaacaaaacaaaacaaaacaaaacaaaacaaaaaaaccccagctgtcatgaaaactaataaagccagaactcactcctcatcccgtactcagggaagggactaatcgacacttaagggctccacctccctctactccccacctccaacactggggatcaaatttcaacatgacatttgaaggcatcaaatatccacatcatagcagctacagacagaaattctgtgcctccaagtgtgaaacctgaacaggatacaaggttacctggtatttaaaccaagagagaataacctgaatctaatcttgacaaaacattaggtaactgtggaatgtgcttttaaaatacggggagaaaaagcaagactctgtctcaaaaaaaaaagggggagaatgaggaaactgtatactaacaaaatgcaagtatcagacagtaaatggaaaaactgaaaatattccagacaaaaggaggcaaagatactttgtaattaaatgtcataactgcctataggctagatcctataattgagggggttaaaaaggacattttgagtcatttggaaaattacaaaagggcagtaggatagttgaaagtatcgtatcaagattaaagttatagatgttgataacagtactgtggttatgtaagagaatatttcaattcttaggaaaaccgctcagatgttattatgtatttaggggtaaacggccataacatatgtaactcaaataattcaggggaaaatattatatgtgtatatatatgtgtgtgtgtgtgtgtgtgtgtgtgtatcacctgagaaaggagagaggaagagagagcaagaacacaagcgagtgacagcgcacaaactattaagtggccacaaaaatggagaaaatattaaaaatatgtgaatctaggtatggagtatattgatgttctttgtactattctgattcttgcaaagtctacagtgcataatatcttcataatgcgttcttaggtgccttaattttttcgctctttaaattttcctgggaaataatttcaatcttatattcaaaaaggaaaagttaaggaatgaaaacagaccaggcgtggtggctcacgcctgtaatcctaacactttgggaggctgaggtgggcagatcacaagatcaagagatcaagaccatcctggccaacatggtgaaaccccatctctaccaaaaatacaaaaattagctgggcgtggtggcacatgcctgtagtcccagctaattggatgctgaggcaggaaaattgcttgaacccgggaggcggaggttgcacgagccgagatcgtgccactgcactccagcctagcgacagagagagactgtctcaaaaaaaataataataaaaataaaggaatgaaaacaaaaataaacacttaaagatacattaacaagatactgtatatgcaaatattttattaaggaaattagacaattttgaaaaacattaaacattccttaagtaatggacagcagagcctatatgggaaaaattttgatgagacccttagttcataaaaacaacacaaaggtgtgataacgaaaatcctctcatgctcacacaaaggctgtgaatagaaggttttagggtaggacagggcaatgtttctccagtaagaaggatgtcattcagtcccttcactctgtagttcttgtcttcagggactaggtacgctgtgaactgaatacgtgtgtccctctaagttcatatgttgaaatcctaaaccccaatgtgatgatgttagagaggtgattaggtcttggggaggtgacaaccttatgaatgggattaatgttcttataggaagggacaggggagccttctctttctttttccctcccttcctctctgccattgaagatacaaggagaaaatggctgcctgcaaatcaggaagaatatacttacctgacacctgatctgctggcactttgatcttggacttctcagcctccagattgtgagaagtaaatgttaattgtctaagctagcccgtctttggtaatttcctaaagcagccggagctggctaggacaatgtgcatgtactccaggggggacttcatatgataaaattggatggaggcccaagaagggacagatgtagccttagcctagctcttgagagcaccagggctcaaggctaccttccagaagaaaagcgagataactgagaggtgaggatacatgggctcaaaatattctctagcctgtgctgaggtgtgaggtccccaaagtcatgagactgattcaataaatgcattttcttctatgttataggttgagggcattagtcttgtttatagatgaggaaatggaggctcagagagatgtcgtgacttagccaaagtcagtgagtagaggcagagtcaggacctgaactctgggggtctaccgccaaggtaaccctgtttttatgttttagttactcatacttgaagcaaacatggtggtcttggaacctgtttctcagctggaacctgtttctcagctggcaataatttcttcagttggaaacggaggtaaattaatagaactaattaaaagaagggtcctgccgggcacagtggctcacgcctgtaatcccagcattttgggaggccaaggaaggtggatcacctgaggtcagcagttcgagaccagcctggccaacatggtgaaaccccgtttctactaaaaatacaaaaataagccgggcgtggcggcgggcgcctgtaatcccagctactcgggagatgaggcaggagaatcgcttgaacccgggaagcggaggttgcggtgagccgtgatcgcacccattgtactccagctgggcaaaaagagagaaacactgtctaaaaaaaaaaaaaaaaaaggtcagtggaaatgctagatgcttagcatattttaaaattcaaaggggctctggaaaattcccgctgtaacggtgaaaaatgtagaatgcaaccggaagctggtgtagaagcgggggttctccagtccccagcagaggcagggcctcacttgtcccatctcaagtcctgttccttccctgtggcctcctaggcttcgcctcctgccctccactgcgggagttagaagaaggaaagaaagaataaagattaaagtgtagataaacgaaacagacaattgaaaaacagtagacagatttcataaaatcaaaagttctttttttgaaaagataaaattgacaaacatttacctagactgaccaagaaaaagagggaagtttcaaaataacgaaattagagttgagagtgggaacattactataggtgttacagaaagaaaagagatcataatagaatactgcgaacaatgtacgccagcaaatcagcccacatgaaagggacagcgtcaatttcagagaattggcgccgggaggggcacgggatcaccgtgcacagtgagtgctgtacaaagtgcctgtgcagctccccgaagccgcaggagggcgcccgactaagccttttctgccctgcgtgaggcgcatgcgtgttccgtctgcagctgcagacgcccatcctgggagtggacaccagcttcgttccctctcagcccactcgggaagcgccacacggcttcggcttcggacgatccagggccgcgtcctctgtgaggaaacagctgtgacggctgaggagggagggaccagctctaactgattgcttaagttgttacagatggtacagagccagtggctgagttttgtaaatcaggtgtgttcattgagcgaactttccacttcggaatattcagcatctgaggaggttcagtttgattttgtctatcgctggcggggcgcgggctgacgcctgggacccctgcacctggggaagccgaggaagatcgcttgagcccaggagttccagacaagcctgggcaacacagcgagaccccgtctctacaaaaaagaaagaaaaatgtgtctatctccaacccaatggtgaaattaggatgtctgtaatctcctcgtaacatcccggattatacattattactttttttacatttcttttttgttcattttcaaaattggaaaatacattcacttgtcttgtaaaagtttgtcgttaaacatacttgcaaattatgttttgcaagagaaaaaaacttttatttttgtttttctttgttgtaagcaagggcaatgcaggtcttcttttttgtcagaattttttgttggaaagcttatttaattttccacttgtttcaaaatattatcccatattgatgagttgcacagaattttttttttttttttttttttgagacaaaagtcttactctgtctcccaggctggagtgcagtggcatgatctcggctcactgcaacctccaccttccgggttcaagcaattctcctgcctcagcctcctgagtacctgggattacaggcgcccgccaccacgcccagctaatttttgtatttttagtagagacggggtttcaccatgttggtcaggctggtctcgaacccctgacctcgtgatccacccgcctctacctcccaaagtgctgggattacaggtgtgagccaccacgcccggcgagttgcatagaaatttctaatctatttgcacgacaatgcttttgattttggcctagtgtatctcctcattcaatatgatatacattgtattatatatacattaaaaaatataaatataaatgtattacttatatatgggtatatgatcagtgttgttagtttgggctggaagtggtccaactgcagttgctctgcctgtcagtgccacacagatgggaaaatcccagctcataattcctgagcactctctaccctgtatgtccctgccacaatcaagtgagtcccttctgcctctatagacactaaaacatccccatagaatcccagagggcaagagtcagagagcggacatgcacactgtccaagcatctctttgcctgacttctgaagaacacgtgtggacagactccaattagtacaaacacagaaaatcacagctgacactacagccgtcttctggcgttatgagagtgaactgaagcagagattccagggcagcatgccacttatttggaagaggaagttgtgcaagtaagtgcacttttccatggagtttgacatggggcaaaaaagggcagacagtttcagggtactcagtggaggaagtggtttatgtagaaaagtggaaatcaaacaactccatgtttccacagctgagatgtcagagaagcctaggaaaaggcaaattccccaaaagaggtcacgtttcaattgtgttttagtcccaagaaaatgacttaaaattgtttccacagctgagatgtcagagaagcctaggaaaaggcaaattccccaaaagaggtcacgtttcaattgtgttttagtcccaagaaaatgacttaaaatactcattggattaaaatatctgggtagtgccaggcatggtagctcatgcctgtaatctcagcactttgggaggttgaagtgggtggatcacttgagttcgggagtttgagaccagcctggctgatatattgaaaccttgtctctactaaaaatacaaaaattagccgggcatggtggcgggcgcctgtagtcccagctacttgggaggctgaggcagaagaatcgcttgaacgcaggaggcgaggtttcagtgagctgagatcccgccaccacactccagcctgggtgacaaagcaagagtccatctcaaaaacaaacaaacaaacaaagactaatttgaccacggcctccttttgagatcattcttttgccagactcctctgacatctcaggctgactgtcttcaaacctagtccacgaacactccttgctggtgtcctgtgcaaagcccccctgaagagtatcagggaacattctgagacccagtccccacccgtgtgcccctttcactatagctgccttggaaacctcctgcatgtcttcacttgctgcagcaatttctcccatcattatcttgatggtgatgacatctgaaagctcagtctagatttcatttgaggcacagtctctgcgtgttataggcacttaagatgtaatacatttcaaactgaggccctcaacttcctccccaaataaaagtgacttgtcctctaatctctaatctcagataatggctccactagtacccagtcatgaatctgacacggcctctcaaaaccactgtcaagcatagctgtgatctctacacggagctccacaatcgccattcacttccacaccaatacccagacagtattcccaccccacactcacactgctcagtgccagtttaaatgtcagttcctcagatgatacaatagttggcatttaaaaaaccaaaccaaacgataatgtttcaatgtccaaaactgatgaacacattttgcttagttctttcctaaatgtggaagtggatctgatatataattattttctccctctgcttcccaacatgttctaatacataatttttagcgataccagtcataatgggggtcccacaaaagaagtttttgtaagctgaaattaattgacagctatttaagactgtcactgtgtcatgaggaattgttggacatgttcaaatgaaaatgagataagctaagaagtatatttttaaaatgttattgatatgtttgctttcattaaagccaggaaggcaaatgtattaaaactttcctttggtataaactatttaaagttaaaatgatgtgagtttttttttcatttttaaaatagatcagttttattctgctagttccataaaaacaatgtaaacacaagcgttctgtacatcttgctggtgaattcacataatgcttagttccctgatcctttgacctcctcgtcttctccagttattttctgtctggaccactggcctcaggagtggagtggggttggggcttaggagagagcaatgtggctttttggtatgacttgttttattgcttgccctctcagcacactcctgtttctcctaacacaaagtctgagatttaagcccttaaacctgtaggtttcaccgtcagctttttctttttctttcttttttctttttttttttgcataggcattactagggacgtgaatgggagactggtatagaaagtggtgaggagccgaagccaagaaattgctttaaacacaagatgaaaatgctctgttctgtccacacaaagaatcacctaatactggtgtgaggcacctcacttagctgtggagaagtccctggaattagatctcagaaagacagttccagctttaagacagtaaaaccttttggcaatgggctaattgccttaaaggaaagaagggttctacttgaaagaacttgcaggtggagaaattgtcctacaaagattcttggaaatgttaatggagataactgacataggtagctgtgggccaaccaggagctgtcaacagcctgatctcagcaaaaccaggacggccagttaatagttccttcagttctctgatggtcacaaatgtaattttatttcatttcgccttgtggaggttctgcaacaaatgtaattttaaaggaattgggagccagaaagataaatgcaactccttcaactatgtgacagggcagactggtgaatctgggttcccagagtgtggagcaagtgccctgcatcagaggacggcccaggggaaacgtgcatgatgccgaaccccacaggacagaattacttcaatcgcctggtcctgactactacaaggaggaagtctcagtgtctcagtttgcatctacgctcagatttctttttcttttggagacagagtctccctctgtcgctcaggctggagtgcagtggtgtgatcttggctcactgctacctccacctcctgggttcaagcaattgtgcctcagcctcccctgtagctgggactacaggcgtgcgccaccacgcccggcttatttttgaatttatagtagagacggggtttcatcatgttggccaggaatgatgcgagttttaatacactcactttacagtttcttatgtttttaaactactttcacgttgtagcaaaaacgaaccttaaaggcttcacagaggccggtccacgggaggggagcgccggtctcccggtcccgccgggctcacagggacggagcggcctgggattccgcccacccccttcccgccgtcagcgattcctcctcctcggagggtctggggacttctcccagaagccgccacctcgcgccaggacaccgggagttccgccgctccctgcgagagggaactggccagaggccctgcggggcaccgcgcgcgagtgaggcagaaacccaggcaccatgcagaaagccccgaaaaatgtccctggagaagccggggaacagctccctccacagccgtcagggcccgcacaggctgtttcctcacggaggactcggccccaggttgtcacgaagccgcgaccgcgcctccccggggtcctcaaggaacgcagcgctctgcctcactgcagacaaggcagtccgcaggcggaacacgcatgcgcgccggcaagtcagccagggcgggttcgcgcgccctcttgcggccctctaggtgcagtgcagggagctttgcgttttagggacttgggctccctccggccatcctctattgctttttggtattttcagtagagacgcggtttcgccatgttggccaggctggtttggaagtcctgacctcaggtgatccacccgcctcggcctcccaaagtgctggaattacaggcgtgagccactatgcctggccctggccatcctctttaactactgaacttcagattattcaaagccgttacactccacccaacagcttcagaatatcctctagtattctctaacacgcatggaacagtctccagattagaccacaaattaggtcacaaagctagtctcaatcaattttaaaagactgaagtaatacaatattttctataaccacaatataaggaaacattaacagaaggaaaactggaacattcacaaatacgtgagaattaaacaacacactcttaaacaaccaatggtcaaagaaaaaataacatgggaaattggaaaatacgatgagacaaatgaaaatgaagcacaacataccaaaactatgacaatcagtgaaagcagtttcaaagggaaaattttacgagtaaacatttacctttaaaaaacaaagatatcagataaataacctaactttacaccttaaggagctggataaagaagagaaaacaaaacccaaagttaggagaaggaagatgctatagtttaaatgtgtcctccaatgtccatgtgttggaaacttaatctccaatgtaacaggggtaagaggtaagacttttaagaggtgattaggccatgaggactctgtcctcatgagtggattaatgccattattaagggagtgtgttcctttcaaaaggacaagttcagcactctcttgctctctcttcccttttcttggcccttctgctttctcccatgggataacatagcaagaaggccctcacaagatgctggcaccttgatcttggacttcccagcctccagaactgtaagaaaataaatttctgatttttgaaaaataaattatgtggcctgtggtattttgttgtagaagcacaaatggactaagacagaaggaaataataaagattagagcatagttaaacaaaatagaggatagaaaaatagggaaaaaatcaacaaaacccaaagttggtcctttgaaaaggtcaagaaaattgacaaaacttcaggtagagtaagaagagaaagattattaaaacactgttattttattatttttcctaattatttaacaatatttaacagtaatataataaaattattgcaatatgaaaatttatataaaactaaaacattaaatcagaaataaaagtggggacgtgactattgattttgaagaaatacacagaattataagagaatattaaatcaattgtatcccaacaaagtaggtaatctagatgaaatggatacattttgagacagagtctcacactgtcatcaggctggagtgcagtggcacgatcttggctcactgcaacctctgcctctgcctcccgggttcaagcgtttctcctgcctcagcctcctgagtagttgggacaacaggcgtgcaccaccactcccagctaatttttgtatttctagtagagacggggtttcaccatgttggccaggatggtctcaatctcttgacctcatgatccaccctcctcggcctcccaaggataaattcttagaagcactcagacttccaaaacagattgaagaagaaatggagaatctaaggatatcttttttttttttttttttttgagacagagtctcactctgtcacccaggcttgagtgcagtggcacgatcttggctcactgcaatcttggcctctcaggttcaagcaattctcctgcctcagcctcctgagtagctgaaattacaggtgtgtgccaccacacctggctaatttttgtatttttagtagagatggggtttcaccatgttggtcagactggtcttgaactcctgacctcgtgatccgcccgcctcggcctcccaaagtcgtgggattacaggcgtgagccactgcgcccggccaggatatctttttaaataaatagaatgaatcagaaaccttttaacaacaaaaagggccagggccaaatggcttcactggcaatttctacaaaacatttgcagaagaattaacaccaatccatctcaaactctaaccatctgtcctacaccccaaaatagaagataaccgatcctaaccctttctatgaggacagcattaccctagtatttgtgaaaaagacttcataagaagagaaaaccaatacaatgttttctcagtacaaaccaatatcttttatgcatacagatagaaaaaatcatcaaaatactaccaaattgaattcagcagtatattaaaagaattacacactatgattagttcaatttattccagatacacaaattgattccacatacaaaatcaattactgctgtatcccacattaatagaatgaggggaaaaatctcacaagattattgcaattcatacaaaacaaatatttgacaaaattcaataccctgtcatgataaaaacaacactcaataaattaggattagaagggagctgcctcagcctgaaaaacccatagctaacatcaccctcagtggtgagtgcgtgtgatgaaatctttcttcctaagatcatggatgtcctgtcttctcaccacttctattcaacatcgtaaggaaagttctggctacagcttacacagtaaatagaaataataggcatccacattggaaaaagagtaaaactatttctttcacagatgacatctagtatattgaaaattttaaagaatatagacacatgtgcacacacacacaattagtgagcatcagtgaattccacaaagcttcaggatacaagatcaacaaacaattggttttatttctatacactaacaacgaacaatctgtaacgaaattaagaaaaaaatttcatttacaatatcaatagtaaaaatactggggaatctggacatggtggatcatgcctgtaatcccagcactctgggaggcccaggtgggaggattacttgaactcagagttcgagaacagcctgggccacatagcgaaacccctgtctctacaaaaaatacaaaaatttagccaggtgtggtggtgtgtgcctgtagtcccagctacaaaggaggctgaggtgggaggatgccttgagcctgggagacagaggttacagtgagccaagatggcaccactgcactccaccctgggcaacaaagccaggtcctgtctcaaaaacaaacaaacaaacaaacaaacaaacaaagaaacaaacaaaaccaaaaacacttgggaatgaatttaaccaaggagttgcaagagttgtacactaaaaactacaaaactttgttcagaggaattaaagaaggtctaaaatggaaagacattctatgtaaattttaagacttaatattattaaaatggcaatactactcaaaatgacctacagatgcaatgcaaccctatcaatacctcaatggcctgtttttgcagaaagggaaaagctgattctaaaattcatatgggtgttaggtgtggtggctcatgcctggaatcttaacactttgggtggctgaggcaggaggatcatttgaggccagaggatcatttaaggctagaaatttgagaccagcctgggcaacgtagcaagaccttgtctccacaaaaaattaaaaaaaaattagcggggcttggtggtgcatgcctgtagtctcaactactcaggaggctgagtctggaggaacgcttgagcccaagaagttaaagctacaatgaactatgattgcatcattgcactccagcctgggaaatagaatgaaagcctgtccaaaataagataaataaaataaaattcatgtggaaaagtaggaggtcccaaatagccaaacaatattgaaaaagaacaaaattcaaggacccatgtgtcttgatttcaaacattgctacaaaattacaataatcaaaacaatacaaacttttcatcagggaaatgcaaatcaaaaccacatcatctcagcacagttaaaatggctttgtatcaaaaagacaaaaaaaaatgaatgctggcaaggatatggagaaagggcaacctttgtacagtgctggtggaaatgtaaattagtatagctgctatggaacagagtatgaaggttcctcaaaaaactaaaaatagaactaccatatgatccagcaatcccactgctgggtatatatccaaaagaaaggaaatcaatatattgaagagatacccgcactcccatgtttactgcagccttgtgaaatactgcagtgttgtgaaatactgcagtgttgtgaaatactggttatttcacaatagacaaaattgggaatcaacctatgtgttcgtcagtggctgaatggataaacaagatgtgacatatgaatatacaacagaatagtatttatccatacaaaagaaatgcaatcctgacatttgcagcaaccctgaatggaactatcattaattggaactagagattaattaaaataagccagggacagaaaggcaaagatggcttgctttcactcatatgtgagagctataaacatggatctcaaggagatagagattagattgttggttaccagagctgggaagggtagaggaggataaagagaggttgattaatggatacaaaaatacagttaaatagaaggaataagatttagtgttcgatagttcagtaagatgactacagttaacaataatctactgaatatttcgaaatagccagaagagaagaattcagatgttcccagaataaagaaatatttgaggtgttggatctcccaattgtcccgattggatcattacgtattatatgagggtatcaaaaatcccatcttccaaaaatacatttgactattatgtatcaatagaaaataaaaagtaaaacaaaacttcttgccagcataaagatagatcaatggggtagaatttagagtatagaaataaacacatatctatgatcaatttatttttaaaagaggtattaagaccattcactatagaaagatactttcttcaacaaattgtgctaggaaaactggatatccacacacagaataacaaagttgaacactttccttatgccatataccaaaaataactcaaaatggatcaaagacataactataagagctaaaattataaagctcttagaagaaaagatagagataaattttcatgaccttggattcggcagtgaattcttatgtgtgacatcaaaaacacaagcaacaaaaggaaactagataaattgaactccatcgaaattaaaacattttctactggctgggagggctggctcatgacgggggtgaaaccccatctctactaaaaatacaaaaattagctggaggtggtggtgcttgcctgtaattgcagcttcttgggaggctgaggcatgagaattgtgagaactgcttcaacccaggaggttgaggttgcagtgagctgagatcgcaccactgcactccagcctaggtgacagagtaagaccctgtcttaaaaaacaaaaaattaccataaaaccttttctgcattaaatgccactatcaacttgagtgaaaagacaaacttcaaaatgagaaaaatattttcagatttgtcttagtctgttttgtgctgctataatggagtaccacagtcggggtaatttgtaatgaagagaagtttactggctaacagttctggaggctgggaagtccaagaacaaggggctggcatctggcaagggccttcttaatgcatcatcacatggtggaaggcatcacatggcagaagggcaaagagaggcagagagagagtaatagggaatgaatctactcccacaatactggcattaattgcttcataagggcaaaattctcatgacttaaagacctcttaaaggtctcacctcccaataccaccacaatggcaattagatttcaacatgagttggccgggcatggtggctcacgcctgtaatctcagcactttgggaggccgaggtgggtggatcatgaggtcaggagttcaagaccagcctggccaatatggtgaaaccccatctctactaaaaaaatacaaaaattagccgggtgtggaggcatgtacctgtaatcccagctactcaggaggctgaggcaggagaatcgcttgaaccttggagacagaggttgcagtgagctgagattgctccactgcactccagcctgggcaacagagtgggacttggtctcaaaacaaaacaaaacaaaaaaaaccccacaagttttggaaggcacaaacattcaaaccatagcaaaatcatatattttataaggttctaatatgcagaatgtataaaaagtacttacaattgaatgaatacgatacaatggaatactattcagccattacaagaaatgtggttttgatatatgttataatgtggatgaatctagataacatgctaagtgaagaagccaggtacaaaaggccacatattatattccatttatatgaaatacagaaaataggggccaagcctggtggcacatgcctgtaatcccagcactttgggaggccaaggcgggtggatcacaagttcaagagatcaagaccatcctagccaacatgatgaaaacccgtctctactaaaaatacaaaaattagctgggcgtggtggcacttgcctgtagtcgcagctactcgggaggttgaggcaggagaatcgcttgaacctgggaggtggaggttgcagtgagccgagatcgcgccactgcactccagcctgggcaacacagcgagactccgtctcaaaaaaaataaaataaaaaataaaaaaaggaaaaaaaaaagaaaataggaaaatccatagagacagaaaaaagactagtggttaccagagcctgggaggaggggggaaatgtggagtggctgcttaatgggtgaggatttccttttggggtggtgacaaattctggacctagatagtgttgatggttgcatgacattgtgaatgtacttaatgtcagtgaattatacactctaaaatggttaggatgataaacttcatgttatgtgtattttgctataataaaatacacagcctcgagcccctgtgtaatcagcgtgaatccatttatgagggtggcaccctcatgaacacctcccactagaccccctctcccaacactggtgcattgaggattaagtctccaacacatgctttttgggagacacattcaaaccatatggtattccccacaatactgatgctcatctgtcatttccatgaagcccccaccactcaggatgcataaaagcttacttagtaggattgatgatgaggcttgcagtctccctgaggagagcctagggccccagaagcgagcttgcacctccaggccctattaaccattagaactcaatccctgttccaaacacaatcagttccttccaccccagcctccccttactgggtcagatttgactgggcattttaagtgcgagcgatgtagtcctctctcctgaattcaagttcctccccctacccagaaatgacaattgcacatacagaagctgatgcgtacagttttaaagaatacaatttctgtgtaaaagtgtcaccatacagttgaaaacatctgtatcacatatgtaacttgctgccagatgccgggccagtcacagtgcactctggctggatgtttcagagatactggttgcctatgaaatggtgaccatctgattctgcagaaccacaaagtgaacacaagtgatgattctaggcatcagtttgctagaaaagggatccagccctccacttgtcacccgaacctcagagcttcagccttggggtttcctttcagggctgtgttatgaaggcagaatccctccctggtcttcacggatgcagaaggagttgctgccaacttgagatctggcacaaaaactaagggaggacttggagagggagtgaggcctcctgagctggggccacagccccaggggagcccagctgcctccatggcccccatcacagagatggcctccccctggcctcgctgaccagagcctcagtggacaggtgtgaaggggcagatgggactccttcactttgctccagtcactcagggctccatctcatcagggcaagctctcttctcaccccacacacccttccaccccgacacgggcacatatacaactgccagtgtgtcccagccccatgatatccatccagacttcagcccaggctgtcccacctctgtgtcagccctcaacaggctttcggcacaggcttgtcgatcttgttaaatgaaaatgtgtttaacaaattgggattgcagaatcaggttgatttatagagtaaaatgctatctgtggctagggccctccagggccctgtgcacacatgtatgcatgctacagctccctgaagccacgcagctggagaacagagccaatcaggttcatctggccaggcaggcagcagtaggtgttcctgaaaccttgctcctgagaccccgtagctccaacacagaaagtctggccaaactgatctaccttggatggagcccctcacctactctgggtccccactctcaagtccttcccagacctagggtgtgaacggccagagtcagacccaacacctgccctcgtgtggagactgccctaccaagaggcccttcctttccattctataccctccatctctacagcaaagatgtcattcctcagccccataagtggcaatgtccccacattcccagccacggtcagctccttaaaacacaggagccaaccttctccatagcctccagggaggagagcatgcagggccctagagatgcccgagtttagggcatgtgacagaaggtgatagggacagagctcagctctgtgctgattcttcatgaacggcttgatgctctccctctggtgatgagtgagttctcacagtcttagttctcatgagaacttactgttggaaaaagcctggcacctcctccctagccatgtggtgccggctccccgtctccttccgccatgagtggaagcagcctgaggccctcaccggaagcagatgctggctccgtggtccttggaaagcctgcagagccatgggccaaataagcctcttttctttataaattaccttcttcaggcattcctttttagcaacacagacagactgggagggtgacccagccgcacatccaggcttctccctagcttgctttctttctttttttttgagacagagtctcgctctgtcacccaggctggagtgccatgatcttggctcactgcaacctccgcctctggggttcaagcaattttctgcctcagcctcccgagtagctgggattacaggtgcccatccggctaatttttttgtatttttagtagagacggggtttcaccaagttggccaggctggtcttgaactcctgacctcatgatccacccgcctcagcctcccaaagtgctgggattacaggtgtgagccaccgcgcttggccctccccagttttctaaagagggacctgggctcctcccctctgcagccatgggtatttaggccaggcatcttggcaggcattaaaccagtatcaaacccatcaggggtttcccccatgaggtttcagcaccttcaagagacttaacactcatgttgaaatttaatccctaatgtggcagtgttgagaggtgatttgggtcacgagggctctgctcgtgaattaagggattagtgggtgaatggattaatgggttatcatgggagcggcattagtgactttctgaggaggaagagagacctgagctggcaccatcagcccccttgccacatgatgccctgtgctgtatcaggatgctgcagagtccccaccagcaagaagtccccatcagcagccccttggccttggacttttcagactccataattgtaagaaacaaaagccttttgtttataaattacccagcttcaggtattctgttacaagcaacagaaaacagactaagacagccgaactactaagcacccagaatgctctgacatcatgggccagcgtgtgtggctaggggaacccaggcacacatttgaacagagtccaaagggacagaggataaaagataaaaggggtgggactctgagttggagacagccctggggctgggctgactgaccccgcttcatcaagagggcaggttcttgttgcctggaaactgattttagggcaacacagggttttccccctttgccagcaggtcactgcaagatgagctcataaataaaggctgaagatcacaaccgtcgctgggtttctgaatatcaagcatgtagatctcaggaaccatcagatcaccatctcagtaggttcttttcttaacatccagggaagtcttaaagccccttggtgcaaagcaagtgcatttattgattcataaaaacgtgcagatcagtacttttcaagaaaggaacattttgaggaggagccccttttatggggttatctgtgttgtcatgctgtgcagtaactcatccacctggggtgagggtggtggcagagtggaggaagtcactactgttatcagggactcgacttgggatccacttgatcctgactgtgttggggagagccttgacctctgacctcccaggcggggttggaggattctggtgaactaattctgtgtaaaacccttgcaggcctgcccccgccctttcccaaagtgcctgactgtgggagagactcttcctacatccaaggagtgctgtcccctcccaaaagggagtgtccaccatccgtgctgcaggctttcccctctacagtagaatttgtgccctgggctgcccctctcctctcagttggcctttctgcttgtgtggactcacaaagagtgcaggaagcaggacagggcccaccaggtgtgttgcaggggggcagccttgctctgcgctccacccagcgtcatgttcaccaccaggcgtctgggggtttcggtttcttctggctcacaggggtcatacgaggaccgcaggctgctgttcattggatttggcaggaatgttatcaccctgggctttggggaaacctcttctgccagccccctgcggttgtgctttggcttcctgatcttgccaggcctgctccacgcccacggctttacatctttgccaccaacagcttggcacaactatgcaatgactaccaccatgagatgctgaatcacctctttgtaaggcacttcctgagggcccagctggggaagggtgggcagtgcgatcccatgggcgtcctcaagtcctcccaccctaggttctgctcccagccccgggttccgggttcttctcattggaagttggtcttctgctgcccttgttatgaggccagtcaagggaggagtctcggttctccaattataggtgccttctcctgacctccagtttctgagggcctggacccatctttggcaagtcccagggcaatcagagcagttcagacctttccaaaagagcactcagcagcgcctgatccttgctgagcatcgtggagaatggaggagtgtggtagcgagctgaggacctgagttgctctggggacttggtaactgtcccatctcctctttgagcctctggggtatggcggccgattgagagtcttccatctctctggctgactgcctctctctgtctccatggaagaatcacgccgaccttgttgaaaccatcatccaggtgctctggaggcagcgcctgcctggaccagagcaagttcagccgtgagcccagcctctgtggctccctgcttgggatccaagtgcttccacactgcatccctggtggtcaaggtcaaggtgagggtgttcctggacttgggggaggggactgagagggaaggccaagggagcactgagactcagcagtgtgccccatttagaggcaactaggggaagggcggtgaagtgcaatgatccggtgctgggctggacagaagtgtgtgcccagcgacaaggcacttctctgtgagctccagcttctgcctctggggggtgggagacggaagcaaggtgtgttgtgctgagcgcacacagatcatgtatggggttagagagggtttttgaaagattttccttcttttgtttttgtgaattgagggactcaattcaggaggagatgctgaaagaaatgatggcatggtattcagtactaagaagaaatgagttattacaaagacatggaaacacatggagagaccctaaatgcctattagtaagttataggagccaatggaaaaaaagctacatacggtatgactccaactacgggacattctggagaaggcaaaattatggagacagtaaaaagatcagtggtagctaggggttgggggagggagagatgaacaaggacagcacaggggtttttagggctgtggaactactctgtgagatactatattggtgaatacatgttacacatttattcaaacccatagaatgtacaacactaagaatgaaccatcatgtaaactatggagccaccatgccccgcccttaataatttttaagtgtaaagttttgtggcattaagtatatttacatggttgtgcaaccatcaacatcatccatctccagaattttttaatcttcctcaaccaaaactctaccattaaaaataacatctcattcctccctacttacagtctctggaaacaaccattatacttcctgcctatgaacttcagtagcctagaaacttcttataagtggaatcatacaatatttgcccttttgtgactggcttattttacttagcatgatgtcttcaaggttaattcatgttgtagcacatgtcagaatttccttcctttttaaagccaaataatatttcattgtatgtatataacacattttgtttattcatttatccattgatggacacttggattgcttccaccttttggctgttatgataatgctgctataaacactggtgtacaaatatctgttcaaatccctgctttcagttctattgattatatactcagaagtggaattgctatttcatgtcatatttctaggttaaatttttttgaggaatcactatattatttaaaaaagcaactacgtcagttagcaccttacttctgcaagaatggccataattaaaaagtcaaaaacaacagatgtaggcctaaatgtagtgaaaagagaacgcttatacgttgccagtgggaatgtaaattagtacaacctctatggaaaacagtatggagattttttaaagaactaaaagtagatctaccatttgatcccacaatcccactactgggtatctgcccaaaggaaaagaagtcattatatcaaaaagacacctacacgtgtatgtttattgcagcaaaattcacaattgcaaagatagggaaccaacctaagtgcccatcggccagtgagtagataaagaatacatggtatatatacaccatggaatacaactcagccataaaaagaacaaaattttctgttttcttttaaaaataatagccactctaatgagtgtaaagtggtttctcattgtggttttgatttgaatttccctaatgactaagaatgttgaggatcttttcatgtgcttattgaccatttatctgtgtatcctctttgaaaaatgtttattcgtgtccattgaataattaatttataacttattatttcattaattaatgtaatgaaattagttttgaactgacattaatttataatcgacaggtaaaagttatatatgtttatggtatacaacatgatattttgatataagtatacactgtggaatgactaaatcaagctaattaacatatgcatcatctcaccttttttttttttttgagacagagtttcgctcttgttgcccaggctggagtgcaatggcgcgatctcggctcactgcaacctctgcctcctgggttcaagcgattctcctgtctcagcctcccaagtagctgggattacaggtgcatgccaccactcccggctaatttttgtatttttagtagagatggggtttcctcatattggtcaggctgctcttgaactcccgactttaggtgatctgcccaccttggcctcccaaagtgctgggattaaaggtgtgagccaccacgcctggcctacatacttatattttttgtgtgtggtgataacacttaaaatctcttagcaattttcaaacatacaacatattaactatagtcactatgatgtacaatacacctaaacgtattcctcctaattgaaatttgtaccctttgaccaatatctccccaactctcccacacccagtctctggtaatataagttcaactttttcagattccacatataagtgagatcatgtggtaccatgtgatatttgtctttctgtgcctggcttatttcacttaacatagtgccctccaggttcatccacgttgtttcagacaacagcatttcattctttttaaaggctgaatattactctatcatgtatatataccacatttgctttatccattcatccattgatggataaagctttgattgtttccatatcttggctaatgtggaaaatgctacaatgaacatggaagagcagatatctttaggaagtagagatgtcatttcctttgggtatatacccagaagtgaggttgttggatcatatggtagttctacttttaattttttgaggaaactctatactgttttccataatggttgtactaatttacactcccaccaatggcgtacaaggattcccctttctccacatcccagccaacacttatcttttgtctttttgataatagctattccaacaggtgtaagataacatctcattgtgatttaaatttacatttctctgatgattagtgatgttgaacattttttcatatgttagtcatttgtagacttttgagaaatgtgtaatcaattcctttcctcgttttttgatcaagttgtttattttctaactattgagttgttcacggtctttatatataggttgtctcttcactctgttgattattttcttggctatgcagaaactttttagcataatataattcactggtttatttttgttcttcttgcttgtgcttccagagtcatacacaaaaaatcaatgtctggaacaatgtcatgaagcttttccccaatgtttttttctaggaattttatggttttgggtcttatgtttaagtcttcagtccattttgagttgatttttgtgtatgttgtaagataaaggtccaattttattcttcttcatgtggatatccagtttctccagcacaattcacagaagatactgctttttcctcattgtgtgttcttggcacctttgttgaaaatcacttcactgtaaatatgtggacttatttctgggcagtctattctgttccatgagtctgtatgtttttatgccagtaccatgctgtttttattactatagctctgtagatttttaaaccaggcaatgtgatgcctctagatttgttctttttgctcaagatggctttggctattcagggtgttttgtagttccatatgaatttcaggagtttttttttccatttctgtgaaaaatgacatagaaattttgataggaattgcgctgaatctgtagattgtgttggtagtatggacattttaacaatattaattcttataatccatgaacacagtatatctttgcatttatttgtgtcttcttcaatttcttccatcaatgtttgatagttttcagtgtacagatccttggttaaatttactccttttttgtagctattgtcaataggattgttttcttgatttctttttcagatagttgttagtgtataaaaacactactgattttcaaatggtgattttgtatcttgcaactttactgaatttattttgtttatgagttctaatagttttttggtggagtttatagtgttttcatgtccttcacagagagaatataactttttcttttcctctttggatgtcttttatttctttctcttgcttaattgctctggctaggacatcctgtacacaaatattcatggaagcttaattaataatgacccccaaactggaaacaggtaggttcccaaatgcacttttaacagaataacatttttcatacttttgttaatgttttttcacttaccattatacatggataattaaatattcttccatagcataattgataatggcttgatggccattctatggattctaatagtttattcaatcaaggccttggttttaatcattaaagtttttttcctctcattttgactattaaaataattatgtctcatctggctgtttacaaacaggaatctcctgtttttagtcaataaataaaatatttagaagcggcactgaaatcccatgggttttatatacaccccaggaagggatagactggtggagcaaagcttgggtttgaaaagctccagtggaggaagtccccaggcccagactcaggccatgccagaagaaaggagaagttttgtctgaagctgtgcttggtaacactccccaccctcccacccacctgatattctcacgcctctgccttgtcaagacatgaatgaggcccagtttgtgcccaggtcattttgcgctttgccatatgctgtgtggaagctgcagagtggccattgtggtgctggtcaagaagggagtgccagaagattgacctttgtccctaaagagaacacctggctgagtccagggcctggttcgaatccagttccagggagcagggaaggtactgagccagtctcttccactgagtgcattccaagggtgttaatggagagtcttaagggatcagacacatgcaccctggggatcctctgttgcttttgtaccagctcatagagtcctagtagcctctgtgagctgaaaaagcctatttatcgccttggaatcagcactcctgccaacaagggttaatcgagatgggaagggaaagaatgtgcagcattatgtgactgtagtttgttatggtattggtggagtgaaattgtgagaaggcatgggaaatgtatttggagtcttataaaatctttataactctgagtcaggttggatctgggtcattaccgaattcctgtgatgtagggaaaatcatgtcaccagttacatctgctgagattctgccagtcaagtggtctctgcctcccaatattaaatgtccttgtcatcttgttatgctatattagcagggagaggctactgaggctgtcttgggaatgactgagcctctttgctgtttccagtcttgtagcttcaacagaacatgccatccatgctgaccttattgaacaagtcaatctcatccagaggtgtagtaggtggtggcccaggaaggaaatctgagaggtttcgagagtatctctccagttctccaagactttctcacaccccaaatccccgtgtctgaaatcctgctaggattagattcctttggcccatgaaggagtttttcttctctgcaaggctcctatggatgtgaaagtggtgatctcactgtcaccattcatcgtagaggagtttaagaaccatgagaattccaagatatcctgcagaatttccaggagcaagctcttgggaaattggacagagctagccccaggcagggcattttctcaccacttttctctgtgctactccggttttactggtcacatatctgcagtggacacagagttcccagagagtgtggaaggcatcaaggaccacaagtctgtgggctggatccagcttcagcctgatttatactctaacttctttccctctgacttgtaacgctccgagcactggccacacagaaaagctaccaggagggagatagcagcttttccctcagaaaacatgagtccagaatctgcccagaaggtgtttctcaccataggaaaagaatagtgatcctgctacgctgatcctccgctcacatttccagatagacctggattgtcctgggactcccacagcctggggaattggagcatcaggattttcctggcgataatatggccataagggacagagtagttcactgctcctgtgaaaagattaggagaaactcctggtgcagatgggatgacagagtttgaaagttttgaatcctgcttacctcagttattatgaggtaaaagctcattttcttctagggattttatatggaaagaataggcctccttctctgatttctatgggatgcaaaaattctcaaatacagagaaggcaatgtcaaaattgtaaggatgtgattgcccaaggcaggcaacagatgcaggagcaggacgcactcccacatgcagctgctgagtgtgcaaagcttttcagaaggctttgggcatgtgaattaaaaagccttatcaatatgtgttactttgcctaagaaattccatttttttatgatcccatggaaacaattaaggttgtttgcaaagactttcctgcagggttatcgaaattgtatttataatagtgaaaaattagaagcaattttagctcttggttccataaataaagtctatattttcgaggtatgacaggtggggaaggacactcaggttgggttccccagaaagttgtgagatggagatttgtatggaggctttcatatcacaacctgcagaatagaagagaagaaagtgggattgggtagagggagaagttaggctgctatgcagtctcagtaagggtgccagttgaccccaggaagagctgcagaactgagacagcccttcaaaattaccccaactttgagtggaagggccagaactttgcccctatgtcaactagtcattggctgtggctgtcccaggaacgacgtgtgttccagggcgacgggatgcccttcagctgagggctgtctgcaagccatactcccagcagctggagaacaaattcctcagttctgaaagggggtcgtgggtggcaccacctgacagccactgcaggccacaccttccaccacttggattcacttcttcatataagttttaggagaaacaactctaggatcctggtgggtctctttttccaggaagaaacttgtaagaggccaagggatggactgcagccaccgtccccactgcagttggtcttaaccctgcagttgacagtgattgctgctgtcctctgctgtccattccaggtgcccctcaacctccactggcacctctgctggtcttggtggcttcccagtggcatgatccagacattcatccctgagcccctggtcaccatgtgcctctcaggctatggctactgcacttatctatttactatgaaaatggggcaaggtagtacagggagctttccagtattaaagtgcattacctgggtgccaaacatatttctcccttcccccactgtgattaacactgtgtgttaatcgccctacttccttctaatcatcaggatcaaatacccctgtcgggatggtgactcctctgcttgctggctggctccttggcagcagctgtagtttacagctcaaaagaacgcttgatgtgtttcccaagggaattgtttcgacctctaaagctacagaacggaggttcgtgggatagggaagcacataaccgtcagctgggtggctggaagtgatggtgagcaaggactctcctgttcccactccttggttcccaggctgtagatgctgcttataggaacacaaccatataaaggcacaggtgtcccttgacttacgatgcagttacattccaataaacctgccttaagtagaaaataagtcaaaaatacatttagtaccccaataaaccatcataaagtcaaaaaattgtgagtcaaaccatcattagttggggaccatctgtagtcgatcagcgtgatctactggtattctaaccatctgctaaaataagacttagctctatttagaggaacataagtcaggaacatctataattttttcaagtataatgtttgccatcaaatgaaatattagaagtcatgcaggggaaaagaaagcatcaattggccagatagcaacagacccagaagcaattcatctattgcagttaacactcaaggatttttaaataaatattatttaaaataaataatatattcaaaagagaaaaaagaatgaagaattttagcaaataaatagaatccatataaaaagaagactaagattccagaaataaaacatctgagtaaaatgaataattcaaaatatggttttaatagattaaaaacaggataataacagaaatacaggtaagtggaaagtatccaggttgatgcagatagatagagaagaatgggagatacagaaaaccgtaagagccatctggaacatggtgaaaagtcctaagctatctgtaactggaaacctagaattagagagagagaaaacgaggtaaagcaatatttgaagaaacctgggtgagaatttccccacactgatgaaagacatcataacacagtctcaaaaagctctacaaaccccaagtatgattcaaaagcaaagaaaacccctgcacacccaggcacattgcagtaaaacctatgacagctaacagcaaagagaaaatctgacaagcagctagagagaaaacaatgggactcacaattcacaatggaccttttagtagaaactctggaagctgaagacaatgggatgtcattttattctagatgcttaaaaaaaaaaagcccggccaggcgcggtggctcacacctgtaatcccagcactttgggaggccgaggggggcggatcacgaggtcaggagatcgagaccatcctggctgacacggggaaaccccgtctctactaaaaatacaaaaaattagccgagagtggtggcgggcgcctgtaatcccagctacttgggagactgaggcaggagaatggcgtgaacccgggaggcggagcttgcagtgagccgagatcgcgccactgcactccagcttgggcgacagagcaagactccgtctcaaaaaaacccacaaaaaccaacaaacaaaaacaaacaaacaaaaccccaaatgacagcctagaactctatttcaagagaaattatcctcctaaatgaatgtaatatatatctgaaaagctgagagaatccactggaagactataataaaatgccagaagagttaatcaggcagaaggaaaatgacagcaactggaacaaggagcttcaggagagaattaagagcacgagaatagctaaatatgtgagtaaatataagcagacattgcttaaaaacaataatagtaatatcttcgggagtttaaaataaatatagaaataaagatctatgacaacaatggaacaaaaggcaaggagtaaatgaaattaaattgtcagtttttttcattgctttgaaatggcaaaatattaatttcaagagtgttccaatgagtcaaagattcatagggaatttaaagggctattattttcaaacatttcagtctcaggactgctttacactttttttttttttttttttttgaggcggagttttgctcttgttgcccaggctgaagtgcaatggcatgatctcagcttactgcaacctccctgcccctgggttcaagcgattctcctgcctcagcctcctgagtagctgggattacaggcatgtgccaccacgcccggctaattttgtatttttagtagagatggggtttctccatgttggtcaggctggtctcgaacccctgacctcaggtgatccgcccacctcagcctcccaaagtgccaagattacaggcgtgagccaccacactcggcctgctttacacttttaaaaattattgaggaacccaaagagtttttttatataggttatatctattgatatttactgtacttgaaattaaaatgggaaaaattaaaaatatttattttaaaaactgggcaggtgcagtggctcatgcctgtaatcccagcactttgggaggccgaggcaggtggatcacgaggtcagcagatcgagaccatcctggctaacacagtgaaaccccgtctctataaaaatacaaaaagttagccagatgtggtgggatgcacctcccagctactcaggaggccaaggcaggagaattccttgaacctgggaggcagaggttgcagtgagccgagatcgcaccatcgcactccagcctggatgacaagagcgaaacttcatctcaaagaaaaaaaaatcactaggaatgtggaagatttgaagaaaactattaaccaactagatctaattaatatttatagaacattaacatctaattgcagaattttcaagtgaaaattcttactttcgtgttattttcaagtgaatatggagcattaaccaaaaaatagaggctgggccataaagtaagtctcaacaaacttaaggattaaaataatatagtatgaggccgagcacggcagctcatcacctgtaatcccagcacattgggaggccgaggcaggtggatcacttgaggtcaggagttcaagaccagcctgaccaacatggtgaaaccccatctctactaaaaatacaaaaaaattagctggttgtggtggcacacacccataatcccagctatccaggaggctgagacacaagaatcacttgaacccaggaagcagaggttgcagtgagccaagattgtgccactgcactccaaccttggcaacagagtgaggctctgtctcaaaataataataaaataataataataataataataataataataataataataatatagtgtgttctttgatcacattggaattaaactaggtatctataatagataaatagaaaatccacaaatgctttacaaccaattaacatacttctaaatagtcaagggtcaaggtagaaattataataaagattagaaaatgcttttaactgaatgataaaatacaacataatccatggacagaaaaattaacacaaaattgcatgtaggactaaacataaaatataaatccataaaatttccaaagaaaacaggagaaaaaaacttcaggatcctagggtaggtaaaaatttcttcaatagaaccaaaaaggtatgacaaaaaaaagaaatgacaaattgatatccatccaaatccaaagcatctgctcttcaaaagacaccactaggaaaatttaaaaggaagttaaagactgacagaagatattcccaacatgtatatatgataaaggacttgtatctaaataaagagcattacaacttaataacaagaccaataacctaattcttaaaatgagcaaaataaacagatgcttcacaatggagagatataaaggccattaagcacatgaaaaatgttcaaaataatcgtcagggaaacgcaaagcaaaatcaccttgaagcactgctgcatatattagaaaagttacaaaataattaaaaaaaaacctggccgggcttggtggctcacgcctgtaatctcagcactttgggaagtcaaggcgggcggatcacgaggtcaggagatcaagatcatcctcgccaacacggtgaaaccccatctgtactaaaaatacaaaaaattagcagggtgtggtggcacgcacctatagtcccagctacttgggaggctgaggcaggagaatcgcttgaacctgggagggggaagttgcagtgagccaagatctcgccactgtgctccactccagcctgggcaacagagcaagactctgtctctcaaaacaaacaaacaaacaaaaacctgacaattcagttggcaaggctgaaagtacctcaaacaatcatacattgttggggggttgtaaaatggtacaaatactttggaaaacaattggcagtttcttataaagttttacatatatttatcatatgaactagcaactccaaacccagaaattgatgcaatataaatgaaaaaaatatatgtctacacaaaaagttgtatatgactgttcatagcagatttattcatcataaccccaaactggaaacaactgtccatcatcgagtgagttaatcagttgtggtcatatattaacataacagtatgctactcagcaataagagaatgaaacactgatacacaccatattaacggatctcaaaactttatgttaagagaaagaaggcagacacagaagagtatgctgtatcattccatttatatgaaagtctagaaaagataattctaatctatactgacaaaaactagatttatgatttcttggagacagaggtgggaagcattgtctgggaaagaatgcaggaaattttgggggtgaggaaaatgttgtttgattgtggtggtggctacacaggtgtataagtttgccaaaacttatcaaaatgtaaagttaaactgggtacaaattgttatatatcatttatgtctcaataaaggtgataaaaatctatttgatacagctaaataggtactttaaagaaacgtatagcgttaaatacaattattagcaaaaaagaattgttgaacattgcttatctaagatttcattccaagaagctagaaaaaaaaccccagaaaatcatatccaaataaaatatttagaagaaaataaaggagcataaattagtgaaaaagaaattagctctataaaagtaggtgggtttttaaaaaaaattaaatgttaagtcctagaaaacctaatcaagaaaacagagtacatacattaccaacaccaggactgaagaagggaacatcactttagatcctaaagatattaaaaatagaacagatattataaactatttaaaaccagtaattagatattttggtgaaattatatggacataatttttaaaagaatttaccaaaatgtacacaagagatataaaatttgattaatcctatgtctatcaaatcattgactacatagctaaaaattttcccaggtgctactctggtaatttttacacacaaaattatggcaaaataataccaaaaccaataataccaatcttacacatcttacccacactcttccagaggaccaaaaacaaacaaaaaaccaaaaacaaaataaagggaatcctcaactcatgttatgagtccataattctgatacaaagtcaaacaaggctattacaagaaagaaaacacagaagacaatatggacatagacataaaatcctatacaaaattttgacaaatttaattcaataatatattaaaaatattacccacaatgaccaaatgaaatctattccaggaatgcaaattgctttaatatctaaaaatcaatttgtatagatgaatcttgaggacattatgctaagggaaataagccagttaccaaaggacaaatactgtatgattctacttatatgaggttatctagatcagtcaaattcatagagacagaaaataggatggtggtttccagggtttagggggtgaagtggggaatggagagtcattgtttaatgggtattcagtttcagctttcttttttattttggagatggagtttcgctctgtcgcccaggctggagtgcagtggtgcgatctgggctcactgcaagctccgcctcccgggttcaggccattctcctgcctcagcctcctgagtagctgggaatacaggcgcccaccaccacgcccggctaattttttgtatttttagcagagatggggtttcaccgtgttagccaggatggtctccatctcctgacctcgtggtctgcccgcctcggcctcccaaagggctaggattacaggcatgagccaccgtgcccagcctcagtttcagctttctaagatgaaacacattctggagatggatagttgcacaatatgacttaatggcactgaactgtacacataatggctaggattataaattctacgtgtattttatgacaattttttaaatgtttaaaatcaaaccacataatttagagtaacagaatgaaaaactataatcatctcaatagtggcaaaaaatgtctgatgaaattcaacacccatcctgataacaaacctcagaaaagtaatttgagtgatagagactatctaaaatttacacctcaagtcataccaaatggtaaaatgttttgttttcctttagattctgggaaaaaggcaaggatgtctacaaatcctatttctggaggtcctagccagtgcaataaagcaagaaaaaagtggtatgaggattataaagaatgatgtaaaactgactttaccacagatgacatactgtgtacacagaaagtcaaaaagaatgaacaattataaataagtgaatttagcaaggtcactggatataagatcaactttaaaaaatctattccatatacatatatatatatatatatatatatatatatatatatatatatgaatgagatataccatatacctatattgtggcaacaatcagaaaatgaaattaaaataatagcatttatacatcaaaaacatcaaatgcatagtactaatctaacaaaacttctacaattgaaaaaatatagtaacttccttttttttttttaaataccttttatttttactcaacttgttaaaggggcagataaagactttggcaaatttgattaacagcacaaaataatgttatccaaactgaataatttattgctggtctgaggcttgccttgtttacactaaagtagaatttacgttgtttccacaaatggcagatatcaacatttaaaggaatttaatagtgacctattcaataaggcaatcatcttggtagcaaacttctatttaaatcttacataactcaagctttataaaaagccaacataattgaaaattgggttctccctctaaagccttaagcattcaaagctcaaaacagttaatttaaaaataagcaaacaaataaaacaacaaaaaaaccctgccagcagatctggctgaaatacttaaaacaaacaaacaaacaaacaaaaactaaatgagcttaatctttacaaaagttatgttagctcaaaagctataaaatcatagttatcttaattctacaaagaagggagagggtcttcatgccaccatttccttaaacctcatctttttcatccaatttggccacatatcaaatttctgtgtgcccctgttttcaagagattcctcttgcagaagagaccaagtataaacatggaagagtaactgcctaagcaggaaagtgttccataatagtgtgcagacaacaagagagttctgagttaatccctggaactcgacctggaccttgatcttgactttgagcgagatctagaacaggatcttgaagtagctctttttggtggaggggacacagagcgggcctttcagggtggaccaggtagcggcgaattggaacgggactggctccttgatctggattttgactttgtatgaccctttccattttctttgggggatccggaccgagacctgcttcgatatttctcatactcatccttagatctgcttcgagaatgtgaatgggagccccgatcagacttgggcttagatttgctctttgatctagatttcctgccttttgatcgagaacgtgatcgacctttgctccgcgacctggaacgggagcgactttttgagacacttccagatctactgcggctgctcctgcgactcctacttcgtgaccatcttctagatcgagacctggatctgcttccagagtaagatcgcctatggcttgtgcgtggcttatcttcaataagcctaatatttctgccatttatttctgtgccatccagtttgtccaaagcacgcttcatgtcagagtaggagcgaaactcaattacaccctcatttgttccttccttgtgggcatccgcacaggttacttaacctgcttgtcgcataaaatcctttaaatctctccaactgcacagactagaaagattttctacaataagcctgtattctgtacgaacaggtggtccgtatttgtctctgccagatgtctccgactgctgtatccacctccaccacggcggcttccgtagctgtagctgtcgcgattgcgacgcgggccccgggcgtgctctacgatcacgcgctcgccgcagagctcctcgctgttcagctcgtaaagggcgtcgtcggtgtcgcgggagtcctcgaactccacgaagccgtagccatttttgaggtctacttcgaggaggcggccatagccactgaaaaagcgctggatggccttctcctggacgttgtagcttaggcgtcctatgtagacgcgcggcatgtccgtggcgggcgggggcccaagggctggttgtggaacggcggaccgcaagccagtagccgcggtgcgggtgcggggacggcaagagcccgaacacgcgcctcacaccatagtggcggccgagtccagccacacaatggttagcaacttctataattgaaaaaattgttgcaaaaatataagaattgctgaaattttgaggttagttcctcaggatccacctgcctcaggtggatcacttgaagtcaggagttcaagaccagcctagccaacatggggaaatcccatctctactaaaaaaaaaatacaaaaaattagccgggtgtggtggcaggcacctgtaaatcccaactactcgggaggctgaggttgcagtgagccgagattgtgccactgcactccaacctgggtgacaaagcaaggatccaactcaaaaacaaacaacaacaaaaccaaatcccaaaatgtttaaagtatctatataaatgaaatgttttggaatactcatagattaaatgtctcaatattcatgtttataacttcacttttccagaattaatctatgtatctgatgtaatgccaacaaaatcctagctttttggtatggggtaattgaaaaaaaaaatcattcaacaatgtatatgaaaatgctaaggacctaaaatagtgacaattttgaacaagaacaaaattagaaaacatacagtttacccttgagcacaagttttaactgtgtgggaccacttatacatggatttacttctacctctgccacttgagacagcaagaccaacccctcgtcgtcttccaccttagcctgctcaacgtgaagacgatgaggataaagatcttgatgatgatccacttctacctaatgaatagtaaatatattttctctcccttattttcttaatcatattttttctctagcttacgtaagagtacagtatctaatacatacacaaaatatgtgttaattgactatattattggtaaggctcctagtcaaacgtaggttattagtagttaagtttttgaggtcaaaagttatacaatgattctttattgtgtaaggggtcagttctcctaacccccgaattgttcaaaggtcaactgtactatcagttttcatttaaaatatttggtattgttacaataataaaagcatacaacgagacatagtccaaaagacactaacatgcatgatcatcggatttatcataaatgttcaactgcaaaacaagggagagagaggaagatggccttttcaataaatgatgttgaacaaattgcttatttgtatgaaaaatattttgacctctactccataccataaatattaatttcagatggatcatacacataaaatagtagatatgtggaagagaatgtagaaaaatatctttatgaccttgagttaggaaaatatttcttaaactgggcaaaaaagcactaatcataaagaaaagttattatcaaaattaagaacttctgttcatcaaaggacatcatttagagagtgaaaaggtaagctgcagatgagatatgtgtaatacaaacatctaaaaaaaccccgtctccagaatatataaagaatcctacaaatgagcaaaaatcagttcccagctaaaaaatggcaaaagtcttgaacaggtacttcccaaagaagatatttaaaaagccaacacatatcgaaaggaggggctcaacagcattatccactgaggaagtgcaaattaaacccataatggaatagcggcatgcacaagaaccaggccctgggagctcaccgtgccactgaaactgctctagtcaggttggtgtgggtcatccccaaccccttccccaatggatacttttcagttcttttgtcatttgaacctgctgaccacattcctcttcttgaggcgtttgcctctaaggcaggaatgggagggagggtttagatgtagtgaggattcggaggcagaatggagggaccaacaaagttggcaccatgcgatgtcaactctgtgacagcagggcttcttaaaggtctgactctcaaacctttcagtcagaaagtggcacattaactatcctcaatgaggattggtctcttagtaatagttaatgtttcactattaaacttcaatcaaaaatggccattttaaccagaatgtcaaattgttcatttatgatggaagataattcacatcagtgtctttcccaatgttaaatacatatttaccctggcatcgtgaaagggtatttgatcctcttatcctccctgaagtgtaactcatcatgccttgttctttttggatgtcaggtctttggtctgttagggccttctggtatcagggacacagcttctgggttcccattgttactctaggcccctcctagcagaagtatttcatagtgttcccagaacttccaagccctcatttatagacttgggagttattggctattttctctctctacacttcatcatgcaaagttcagaagctttacacggcctcttccataaagacacctgttgttgccactgtgaccttttctttggtggcatgttgaaagtggaacttctttctgaggcttgaggtcttctggtctacagcctgggcacaagttccagatattcttgggcacatttttcatctatctggaatttctatcacctcctacaaatgaaactcagtgggtggtaggaataagatgctaagtaactttttttggaatttaggtaacatcagaaccaatttccatgctctaagatgcatgagcacctctccccctcattgtatatccagcactgagggtaggtcctggcacattgaaggtgtccaataaataaaacgcacaacgaaaatatttttccttttaatgtaaatattacaggttcattgcaaggaaaaaattaacttaaaaacacagaaaagaaagtaaaaaacaaaaaattgatgaaccactaaaacagaaataaccatcattaattttttggagaccatcctttcatctctctcaaaagttcacataattacataatattacatttacagttttataccataaaggcagcatttacatttttctgtttttacagtctccccttcccttatctctacttctccttttctcactcccctcaaggtaatcaatattaacagcctggtgtatattcttccatacctgtctccatgtgcatctaaccacacacacacacataaacacaaaataaatgggtgtgattattttaacaaaaatgatatattgtatatatacatttgttataaagcaattatttatcaatacattgtggaaatacattgaaatcagctagcatagatataagtcgtttttaaaattactctcacactgttccataatatgggtatgtcacaatttatctaaccagttccctattaatgggcattcactttgtttgcagttggggctttgcccccctctacaaacagtacttcaacaaacatgtttatttacattcttatgcattgatgctgcttttatttctaacggacagattccaaaagtgagactgctgggtctaagagtatatatgttttaaatttttaaacatatattgttggactgctggtggaagtatgttacacaacctttaagtaatagtacatggtttcccaaaccccaatagctagcaaaagatctcttaatttttgccagatccatgaaggggaagtttcatctcactgagcatttcaatttgcatttccctgagtgctttttaggttcaaaatattttcacaggataatgatcacctacagttgctctcctatgaagaaccatccagtccagagggattaaagacttaagtgtaaaaaataaaatcataaaaatcttaaaaacacatttaggatactacgtataacctagggattaaggagatctcttttaagtaaaatgagtaaaataaaaaatctaaaaaggaaatgatacaaatattttcctataaaaatgttgtgcattactataaagtataaagacaaatgctagattaagaaaaacatctgctacataatgacaaaggattaatatcaaaaatatataaaaagcacctccaggtttataagaaaagacagataaatgaatagaaaaataggcaaatacatatataggcaattaactaaagataatttgttaaatgagtaaagtatgaaatctggatgaacactttcatttgttcattattttcctctagtgagagtttccttataacttctaagatttaatattattaaatgatttcccacataattgcttatagtttctctgtatactttctgataaattcctaatgaagattttcctatattcataaaatatagtttataagattcatcttgtggagttgacatctaggtgaatgacttattgttctttatattaactgagtttctctttgatgtattctttgatgtacagtaaggctcgaactactcctgaaggcttttccacattcattacatttatagggtttttctccagtatgcatcctcaagtgtacagtaaagtctgagttagttctgaaggcttttccacattcttcacatttatagggcctctccccagtatgaattctctgatgtagggttagctgtgatagagtaatacaaccctttccacattccttacaggtgtagggtttttctccagtgtgtgttctccaatgcactgtaaggtaagaacccctcctgaaggcttttccacagacatcacacttatagggcttctctccactatggattttctgatgttctgtgacatgtaccatctggctaaatgctttcccacagtcattacatttaaatggtttctctccagtatgtgttctttgatgtgtattaaagcctgagttacttgtgaaaacctttccacattcattgcatttatagggcttctctccagtatgccttcgttggtgcacggtaagctgtgatgtattagtgaaggctttctcacattcattacatttatatggtttttctccagtatgggtcctctgatgtacaataaggtatgatttagtcctaaaggactttccacagtcataacatttatagggtttcactccagtatgaattttctgatgctccttgagatttaccattttggtgaatgccctctcgcagtcagtacatttatatggtttctctccagtgtgaattctctgatgtacagttaagtgtgattttattctgaaagactccccacattcattgcacagataaggtttctcttcagtatgaatacgctgatgtataattagagaagaagaacgcatgaaggcctttccacattcagtacatttataaggtttctctcctgtatgcattctgtggtgtacagtaaggcatgaataattaatgaatgctttcccacattcattacatttatagggtttttctcctgtgtgaattcgctgatgttctgtgaaatttgcgatgcggttgaatgctttcccacattcattacattcatagggtttttccccagtgtgagttcttatatgtacgataaggcttgaattacttctataggcttttccacattcgttacatctaaaaggtttctctccagtatgaatcctctgatgcacattaaaaattgtggtattcttaaaagacttcccacactcgttgcactgatatggtttctcttcagtgtgggtcttctgatgtacactaagatatgacttgttcctaaaggctttcccacaatcatcacatttgtagggtttctcaccattgtgagtttcctgatgtcttgcaagttttgatttatcactaaaagctttcccgcattcactacatttatagggtttctctccagtttgaattc

SEQ ID NO: 6 - DNA, 995 bp, Homo sapiens
gcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactaccgccagaccgtgcgcgccctcaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggatagcgaggctgcggcaggaggagcgggagcaggagcagcggcaggcgttggagcaggcccgcaaggccgaagaggtgcaggcctgggcgcagcgcaaggagcgggaagtgctgcagctgcaggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacccaaaaaa

SEQ ID NO: 7 - DNA, 2348 bp, Homo sapiens
tgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgcttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattttgtagctcagtagctgctaataaagttaaagatcctg

SEQ ID NO: 8 - DNA, 2363 bp, Homo sapiens
tgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaacaataaactcagttcagaaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttactgtaaaaaatgatacctctgtcttcagtaa

SEQ ID NO: 9 - DNA, 2068 bp, Homo sapiens
ttggcttgtattatgcttggctagatgagacttctgggcagatagtaatggaaattacctcttccaaagagataaagtggagaagaaactcctgtaagtttataacctgcccttggtagcctgtctccattaaaccctatctaagtgagctagacaacccccaggggttggcagactttcgctgtaagaggctggatggtgaatattttaggcattgtgggccacatgcagtctctgtcacgtattcttggtttaaactttcttggctcatgggccttgagagctatggtttgccaacctcttatctagggtttagggtctttaaagaacctattagaaccccctttcctccatgggaaaaaaccctgagatgtttgagaacctttatttactcattatttttctttccttctctcaatcagcagcacccacagtaggacaagatatggggtggagacctgcgggtagttaggcagataaccttggggcccacctgcctagtggtgtgtcagtgaaagttaatccattttcagtctcctgggtacatcttttttaactcccactttcatttttctctgcctgtttcccttcagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaattttt

SEQ ID NO: 10 - DNA, 1221 bp, Homo sapiens
cgcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccctttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttccc

SEQ ID NO: 11 - DNA, 1104 bp, Homo sapiens
ctcggtgcgcgaccccggctcagaggactctttgctgtcccgcaagatgcggatgctgctggcgctcctggccctctccgcggcgcggccatcggccagtgcagagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcagtgatgatgttgctggagaacaaggccagcatttctggaggaggactgcctgccccataccaggccaaacagttgcacctgcactggtccgacttgccatataagggctcggagcacagcctcgatggggagcactttgccatggagatgcacatagtacatgagaaagagaaggggacatcgaggaatgtgaaagaggcccaggaccctgaagacgaaattgcggtgctggcctttctggtggaggctggaacccaggtgaacgagggcttccagccactggtggaggcactgtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccggtccttagccttcccaggtgggactttaggcatgattaaaatatggacatatttttggag

SEQ ID NO: 12 - DNA, 199420 bp, Homo sapiens
gaattctttttttttttttttttttaaagtagaaacaggctctcactttgttgcctcggctggtcttgatctcctgggctcaagtgatccttttgccttggcctcccaaagtgctggagttacaggcatgagccaccacgcctggcccacatgtaaacatttaaagaatttgagcggagccatccaaaaggtcatggtgatttttctgaaaaacagaaagcagcaccttagctgtagagatgctagaataactgctgtaacatcccagacacgctgcatgcatcttggagcttggatcagggaaaatagttgtggattcaggccctgcagtattagtgcgttttctaagtggtcacagtctggcaagggtgggtaaagaagggaggtagagtgaagagggcctagaaaacagctggtgcctaaaatctaattagcatcagcctgtagtctttaaggagctccagtttcctgctccttggggttatttgctggtcttgtgtgttatcttttcctgtaatgtttcttcttatgctttggtgctcctcatgctaatgctctggggtcctttagagggtgtggctctgatgatcactgtcacatttcatctgtaggcacatcctaagccaggaagagacatcgcagagacctgtcctgaacacatcctcataagaggggagtgtcatccagtcttcttaaccccaaaggataatacaaaatagtgctgagagtaaatagattgctttcgctttagtttcagactgagatcttgaggattaagtaagatgtgtgcatgtgcaggcaggagtagaaataatgaatgtaagatgtagctttaacgtgtggactttgtaatttttgagatgagagtgaaaacttcagccctcacttagaaagaaatcacatttggctggaagtgctgtttctcccccatgttatgctatgtaatggattaattataaaaatggtcacaattactctcctctttaaatctatttccttgagataggactttgcagctcctcttatcaagggttggagtctctttccctagcctgtgaatgtgggcttggcctttttacttactttagccaacagaattcatagaagtgaaggtgtgtgggtatgtcagttccaagcccaggtcccaagccaaggtcttaagaggctcacttacacaattctgcttgctctcctagaatctggcgtctcttggaatgtagacagaatgggcttgcttgctgtggcccagagaccccatcaccccaggtgacagtgaccttacactggccacgtgagtgaggcaattctagaccagccagctaacctcagacacttgagtgggcctagcagagatcggacaaatccatccagatccatagactcataagcaataataaatgcttattgtttcaagctactgagttttggaatagtttgttatactaacatagccaactgatacgtagttccctggacatggtccccttatggggtctattaatgtcattataaacccttagttcaactcagtagaagagattcagtcactggatggaggggttctattaaatgggggtggtgggtcctcaattcttgtgattgtcagcattactctgagacatttttaacacagatgcctaggccttgtactagagtattcaatcaaatatctgtagatgaaggttcggaacctgtaatttttaaagctctggtaattgaccaggattaaaacccaataattcaatggtcttgtcaatcccttccattactgaaagatgcagtgattccagttcatctatacttaaacaaataacactcaggtggttcagagttcattactgacttgatagacttctagctgcaaaagtaaactttatgatcacctttggccaaaagcaaactaacccagatgctagatgggaaaaatccacagttgcatattgatggctagaatgtatattgtttaccattgtatctgcctggggtttagacatgatgcggactcatgaataaatcctggacactgggaatgtaataggaccttgctttgaggatcttagagtcaattgaaaaaaaaaatcaggtataaattacttataatgtagtaagaaaacaaagcaagcagtattttaaccattaaatttcaggtgaaattttactatggcatatgtaccagttgttgcttacaataatgctgctttacaaacaaccacaaaatctgttttatacaacaatgtgcatttcctaaccactgtgtctgtggtttgaggggggcaattggttgattttaggctggactctagaggcgggtagctttataccatgtctctcatccttcccttggcaccagccgctacctttagcatgttattctcgtggagatggcagagatggggctacaagccacagtgtgcaagctcattttaagcttctgataatgtcactaatctgttagcatcctgttggtcaaggaaagtcacatgaccaagcacagcgccagggcagggaaatgtatttcacttttttatttgttttaattttttattatattttttgagatagagtctcactctgtcatccaggctggagtgcagtggcgtgatcacaggttccgtctcccaggttcaagtgagtattgtgtctcagaccccggagtagccgggattacaggcaccggccaccacacctgactaatttttgtattttcactagagatggggttttaccatgttgaccaggctggtctcaaactcctgacctcaagtgatctgcccgcctcagcctttcaaagtgctggaattacaaacgtgagctaccaggaccagcctatttcacttttttagtgtgagaaactgcaaatacttgtggcaaagggcatggatatggagaagagtgaagaaatagagccattaaaatactcttccccagtgggagaagggtgtatgaagagggagttgcattttttcctgctttggaaggctcctaaagtcctagctggaccctagaataacccagaagcagagaagtgtgcatcctctggagccgtcttctgctcctcgtgatgtggaagtaagcaggggactcatagctgctgtggtctgtctaatggaattttgaagggaaagaaactcctgccttgtgcagtggctcacacctataatcccagcactttgagtggccgaggctggcagatcacttgaggtcaggagttcgagattagcctggccaacatggtgaaaccccgtctctactaaaaatacaaattagccgggcatggtggtgcacgcctgtaatcctagctactcgggaggctgaggcaggagactcgcttgaacccaggaggtgaaggttgcagtgagccaagattgcaccactacactccagcctgggcaacagagtgagactccgcctaaaaaacacacccccaaaataaaaaaataaataaaaaacaaaagagaaagtcctgaagatatctcaaacttgatagctgcagagatggcattggaattcctgtagaatgcctctgtttccattcccactgtatcctctaaaatgtaaagattatgggttactgggcttggttatccacttcccagttccaggaggggtattatgtgtgtggtgtctttactttagatcacatgatatccccttattgtcatcccgtttttctcaggtgaaaagatatgagtttccatctactctgaacactgggaccttttcccatagccgagcccaacattgcagtggttaaaagagatttgggtgagactgtcccttcccgatggcacatctttccctgatttattttgtgaaaggcttgtgcctaagcctctctcattgagacaggaaaccagtgttgtcacatatgattgagattctcagatattctccagggcagaaattatgttttatggtgacactaagaagaagaataaagcactttattttaggccactaatttataggctttgctattgatcattctgtgcctttcaatatatgtggctagtttggtttgtatatttgtcccctccaattctcatgttgaaatgtgatcccctattttggaggtggggcctggtgggaggtttgggtcctgggggcagatccctcatgaatggcttggtgccctctctgtgttaatgagcgtgtgctccctctatttgttcactcaacagctggttgtttaaaagagcctagcatctctcttgctctttctcttgccacgtgacatgccttctcccccttcaccttcccaccctgagtaaaagcctcctgaggcctcaccaaaagcagatgctgctgccatgcttcttgtacagtctgcacaaccatgagcccaaataaacctcttttcttttttctttttttttgagacagagtctcactctatcacccaggctggagtgcagtggtgcgatctcggctcactgcaacctctgcctcgcgggttcacgccattctcctgcctcagcctcccatgtagctgggactacaggtgcctgccacaatgcccggctaattttttgtatttttggtagagacggggtttcaccatgttagccaggatggtcttaatctcttgacctcgtgatccacccgccttggcctcccaaagtgctggtattacaggcgtgagccaccacgcccggccaaacctcctttctttataaattacccagtctcaggtcttcctttgtagcaatgcaaaatgaactaacactgtggtgtatcaaatttacctgtgaggaaactgaagtacaaaggattatgtaaccttcctgagatcacatctaatggccaactgagattagccacctatcttcttgttttttcagctttttcttggcaatctgctgatagtaccttgtttcccaaaacaagcattacttactgagtatagcattacttactgagttgatcttcctaagaaaccccgcctccctactatttgtgctccatgggaaaaaaggaaatctagcaggaaggtgtttaacaatgtgagatttccataccacaatgttagagaaagtaagctggattataggtcattcctaaactgcatttcctgaagtttcttcattactgccctgaccactgaaatagacggcgaggagactatttagaagttctcacaaagtctttgtgactgtgctgcttttacatgttttctgagccctcacctgccatttctgttgcttggtgactgtaaatgagggatcataacctcatgttcaacagtggttccctgacagattatactatttctgttttatgtgaaaaaatttgtgtagttaaacaacgtgttttaactaatgttttgtaggaggcatgatatgattggagcaggcatttttattggtatttttctccaattaacacattgcaaacaatcaaataattataatggcccagaaaatatagggtctgctccaactgatagataagctggttatcttggataggttgttacctttctggtgacgtttttgctgtaaatatcatattgtctcccgtatacatggatgctacataatatattgttgtttgagcaataatttcatatcctcctcctcttcttgctcaatgccaagggccatgtctgctctgtttaccacttaaaacctgggagccagcataatagagcctaagtaggtattgaatgagtgaatgagcaaatgctaagactacagcacccagctcataagaaaaatttgggattcttcccaggtgtttctgcccctgagaaaggacagtgaagggttaatgttctctgcgggagcaggagggatttggatatggatctcagcagagctgctggaatcacattctttctgctactatagcaacaggttgagaattctgccagtatcgtcacctgcctacgttggaaatgcctgcgtgcaggcgacttcattgtctggggggaccactgttttttttatgatgtttcaataaagcagcttctttttggagacaaagagacagcacaaagcaggggctaagaatcatggaaaggcagagagagatcttgtttttatctgagggacatttccagtcttttgtcccttgaagaggtgttgagtgaggaaggaattgaggttttatctgtagttggtagcatctttttctgtcttctaaacgaggcctctcttctgagatgtaacccctggcaacatttcaaaaactttctcttactattattgcttagcaaatagagtgatagtaaaaactcttgcctgtgttcacttctaaatttggaggtgccagaatggaccagaatgtaggttttcctctgcatttaccattcttctaaccaactctgtatcttcgttgtttactgagaaggaaaagctaaccaagaatgcaaaatggaggtgttaggccaggcatggtggctcacgcctgtaatcccaacactttgggaggttgaggtgggaggactcctaaagcccaagagttcaaggctgcagtgagccatgccacttcactccaccttgggcaacagagtaatacccccgtctctaaaaacaaaacaaaaaaaaacaaagaggtattatttttatttggtgtagcagtgttgtaaagagaagaacatgaggaagctacagaggaaagttgcttaaatggtattatgttcccagggggcttcacagcatgtaataaaatgcctagcttattactcaggcctgtttcttgtgatctctgtaagtggcagggaaggctcaggtgtggtgataatcagagcttagggctaattgtggatcttgctgggttaatgcatggaatcaataggccttaactgtcactttggattgatggatcactttgccacagtaccatgatgacatctacatcttgttttcactttgcgtgctggcaggaaaatctgcctggttcactctttgttgctggtttacaaatacatcttgtcaaaaataacctggacatattgagcctttcttcacaaacagcacagaattcaatttttcaaagcttttatctttatcccactatagaccatttgaatataggataaaccctttcatcttgtataaatttcaagggcccccatcactgccttgaagtttgtgtggccactgaaactgccgttcttgtgccagtgtagtcaaaagggcactgggttgggcaccagaagcctggacatctggtcctaccaggaagtggccttggccagctcatatggggattttaatttcactatatgtaaaatgaaagacttggatgagatttccaggatttgtcttacatctcttcctacatgtgaaaaagcagttgttttaaaagtagcacaggctttgcttcactgaagtcttacaatttgcaaggcactggaaggctctgtcgcttacttcttccctaactcttagtcacacaccacatcacctctctgcttcagtattgcttcatcagggaagccttccttgaacctcaggctagatcaggactcccacagtatgttccctaataaatctgttattttctttcatcatacttaaccacactttgtaatgaatgatctgtttcattagtgtgtgtgtgtgtgtgtgtgtgtgtgtgtatttttttttttttttgagacggagtctctctttgtcattgaggctggagcgcagtggcacgatcttggctcactgcaacatctgcctcccgggttcaagcgattctcctgcctcaaccccctgagtagctgggattataggcacccgtcaccatacctggctaatttttgtatttttagtagagatggggcttcactatgttggccaggctggtctcaaactcctgacctcaagtgatctacctgcctcggcctcccgaagtgttgggattacaggcatgagccaccacgcctgcctggcctggctttttttttttaatcaattttctttctcactgtgagactgaagagttgtgaagcaagcacccaatctgttttgttcaccatcgtatctgcacgtaggagtcatgcagtaaacattcactaaacgacagaaggtgctgcgtcaggctttatggagagtctaaagatgattatattgcagtctctgtcctcaaggatcttaagatttactttctctgtttttcttctcttcctttattatctacctctaagacccaaaatatgctactggaaattaaaacaaaacaaaactccctgggttcttgtctttgatctaatcactagataggttttgattttccttgcctggactggtaagtcttttgtgacagaaaccacggaatgaggccaggccctggaaggagattatagtagatagtatgtagaatggaaattgtagacagaaagagaaagaaagaggtaggaagggaggagtacaaggaggacaatgacaagaagagcaatgaaaacacggggctttgcccttttaattagtttgcctgtaagggtccttcttttttgactgccgagccttacaagcaaggacgtgtttcttaaatagaattcttaccggcatcgttgtgtaatagcacaaagaatttgctaccaaaatatgattacgtgcatacaaaaagtggtctgaattgcataaaatattttgctttcaaaaaattaccagttttcaaaaggattggcaggttcctgcaaaccagtagttatggtcaatacaagcaaatgcatcatgaaaccagagctagccattacatcagttatgtttaaacaatgaagggcaatttgattttaagcagctaggctaagtctagatgctgggaggcaagagggagaattccttaggttggaggtgtgatggacgttcatctgctaggtacagaagacttagggggaagttgattgaattagaaggtacaacttcttttcttctttctgagtttgcaatttatagaggaagtagttcaggggagttttactatgtaaattaagtttcagtagaaagcataagctctccaccttcaagaagtgaagtagcctctttgcgttaccttgaagacaggtgtagataagagagtatgggcaggtaagaccagtaaaagtttttctgactcctctccctaagtgtttagctttaatggccaaagtcaggctttctctgcatagttatctgaggttcccttcttgccagcacccacagacacagtgggtgttagtagcctgcctttttatgcttgcctggtccagttgggagcttagatcccagcagactctatccatcccagaaccatttcacgaaaagaaaatgactaagacaatcatgtaatctctcttcttatgagggagaaggaattttagtcaagaatgcaaggtgtgcctgcaggctttacacctatgctgcacacatgctacgtacacaagcgtgggcatgtgcacacacacacaggtccattctgcttattcacttactgatgaagagacatgccgtgttggctaaagatcaggaaataattgtgttgggttgacaagcagccaaaccataaggctcacatgtctcattgggcaatattaattggccaaccttcatttaaaaaatatgcaaaacagaagtaatatgtatgaatgtagtgctttcctatctcatatcccctgactcgtttccagagaaagtctcctataagcattctctttgttttctagggatctgcttctttctagacctgtgggaaataaataacattttaacagaattatttctaaagcaaatccctttcttttcagtggcaaagcctctgttaaatctcagctctgccacttcctaactgtacaactagcagcgatgttatttaacccttgtgcctcattttcgtcaattttatgtggagttaatagaatgtctctgtcataggattcttgtgagaaggaaataagatcatctaagaaatcttcttttgtacagtacctggctcatcgtatgatttttaaaattgttactgtatttaataatatcttgaagagatattcagccttttcttttctcctttacccttctcaaattagaaacaccccttgtgacatctggtgcttctcaacatcaggggttctgctggggtaggaggagcctcggtgaggaagagaggcgagcagagcagagcagagcaaagcagagatgattaggcaggaatgagggtgatagagacctattcccatactcttctcctgcctcctattccattggtctttctggtatattatactgcttcttaacctgttggtggctgggtataatactaggtgcaatacaaaaaagaatataaattcagctctattgtccaagaagtggtcatctaagtcccaggcttactttcccgtcttctccaagtccatatacttgccttttagctcaaatcctagctcaaacctaccctgtgcactgatgcctaatagggaacaagtactcgagggatatcagtggcacccgttgactcaccatagaagacagagacatagtcctcaaatcctttgcatttagagaaaaacacctatgaaaagtcaaaggcctttgcatttagaggaaaacacctatgaaaagtcaaaggtcaaatatcaaacttcctaaaagctccattccctctggactttcaggcttgaggggaaggaatgtgaatcattggacctggaaagagggcatggggagaggaaacaggaggtttcctgtccatctctgccgtgaaagagatgtcagtgcaatgcagcagcgtatcctgatacacaaaataggagagataattgaatattaaatgagatgtgtatataaaacatgattttagggcctggaatatagtaagtcctcaataaatgttagccataattagttcatgaataacatctggatactcagctatttggagggcaattagacttctcagtcttacgtaaaccttactgcctattcctaatgctgccagccactcacatgttgaccacattgaatggggaggagatgctgctcacactggtccatctatctgcacctctagtttgtcttaattgttcataggttgaaattaaatgacccattttgagggttcacagttactgttctgtgcaagagaagaagtgtatgacaagcaggcacatcacaaaacaagcaggcagctctcctggcaatgactgcaggatggtactatatttacatacattttatctttaatgtgaatttttattttactatgtcttttatttgtgtcttatcaaaagcagtgtaatattcttaactcattctggccaaagttgggtgacttacaccgttgtctttcataatataaagtagaagaagaatatatatgaattttagggttttaaagacaagatgaattcaggatcatctaatccagccccctcactttaaagtgtggaaattgattcctggggtattaaataatgaattttctgagtggcagaaggggaggtctcccagctctaattcagagtcctgcatatatgatctcttgacctgctactcttccaaagtgaccatgaacataaaactgtttgaaagctgctgttttgaaatgtaagagtggtcatctgtgcagaggattctcaaataagataccaccacctttggcccagtctcttcctgtctttggtacgttatccctaactctccacaggaaatacatgcctgcctattatttggaagaggcaatgatgacagaaagaatggttcctgttttttccctctttaggatagctcctccccaaaccctgtcccttagatacataatcatgatcaaaacaaaataagattcctgagctacatacatggctctagggattgcctagagtgtttcgtagtgaaacctcatgctctagctctgcaattccaaggaaggatcagatttgcagagcactagacctagggatttattaatagattttctcaaggataattaagtgatttaaaaaattatcataactaagtaaaattttaaagtacatgtaaataaatgagaaggcatagagaaagtatttggagacaataaatatacattcaagatataatagatattgttcaaaccaagatttagcaaattctagaattatacagactagactaaatttttttctttatagattatcttttttttaatagttcagatctaatatttggtacctccttgtttgtttaaagccaataataacaataactgttacctgtcaagtagctgccatgtgccagtgtaattaatgcttgtcatgagatctcatttaatttgcacagtactgtgagttaagtatgatttccctcatttattgataaggatactgaggctcatgggtcaaaataacgagtttttttttttttatagaattttgacaacctatttccattctcatagaagcagggcaaagcaagattttaggcaaacaccagggaaaggttaatctagttgctgaaccaaataaagcactcctatcagaagcccagcctattctccctgcccttgagaatattgaagacatagccttttaaagcagcctttctgtctcaaatcctgccacaaccctttagtgtatgtatgtatgtatgtatgtatgtgtatatatatatatatacacacacacacatatatatatatatatatatatatatatatatatatatatatatgggtaaaaccatgtcctctgggtgaatttggttgtctcttgagaatttctgtttcctccctcagttcttttattctcccttgcaccaaaagctgccctctcttctttgctccctcccctgcccatgggttattagggatggacgtagagttgtagcatgagtggccaggccttattagacgccaagagggatacccttgaataaatgccccaccttcagcatgtagaattctggggttaggttttgtctgctcagtgttcttttaaaaataatttctaggctgggcacggtggctcatgcctgtaatcccagcactttgggaagctgaggtgggcagatcacctgaggtcaggagtttaagacaagcctggccaacatggcaaaactccgtctctactaaaaatacaaaaattagccaggcatggtggtgggtgtctgtaatcccagctacttgggaggctgaggcatgagaattgcttgaacccaggagacagaggttgcagtgaactgagatcgcgtctgcactccagcctgggtgacagagcaaaactctgtctcaaaaaaataaataataataatttctgagtctgagctagattgcataaatccagagcaggtaagcgtaatgacagtgtttcaaacatacatttctgtttgggaagtcctttcagaacccatttatattcaatagacaaaagccattttcctttagcttctgtgtcctaataaaagataaagatataacagcttcagatatattatctgattatcaaccatgcccatcagatacagttgacccttgaacaacatgggagttaggaatgccacccccaagcagtagaaaatccacatataacttgactccccaaaaacataactactaaaatagccaactgttgactggaagtcttaccaataacataaaatgattaacacatattttttgtgttatatatacactacagactgcattcctacaataaagtaagctagagaaaagaaaatgttattaagaaaagcataagaaagagaaaatatatttactgttccttaagtgtaagtggattatcatcctcgtctccttcacattgagtaggctgaggaagaggaggggttgtctggggtggcagaggcagaagaaaatttgcatataagcagaccagtgcagttcaaacccctgtggttcaagtgtcaacagtagactattaattctttctcatttacaagaagattgaggctcaactaggcttttctattcaaaatcacacaccagccagtgacatttggattccagatttctctaactctgaagcccaggctcttacatactgttttgtattgtcccttttttaaaaagaaaataaatttatagaaatttactcactagctttgagtccaagtgagttttgactgttttgaaaaattacactcaatcagcctcaaggaatgaagattttctactgcttagttcatgctgaagacaacactgaccgttctgaaatgcttccaaaagatgcaatccagaaatgcctaatgttataattgcatcagtgcaatctgtgcacggctcaccagcttagactcacttgaaggtgtaatttctttctgtgtgttttttaaatttctcttgttaattctggcctgtgctcatatcttgtgaaatgtagaggatctaagggagtgatcactgagatgattccccaaacatccttccagttataacagtcagagtttctataggtgtgcacctccccatgcttgctattcatgatcaacttgacttttagaagtgctcattatttaaatgatattccacccaaattattgtttgctccccatttaaataatcagtgcttgttgctatagtgccaactaaaaaagatagtaattatcctgcttgggcacagctgcagagctgactttgcttgctaatttgttaaagggttaatgtcctattgcatttttttaattgtctgctttattggaggatgctcagttttaactggatttcctcttctttatttccctaagagccaatgagatgaaaatgccattgtttttcctaatgtggtgtcaaggcagaaccatctctggggatgtcaggaagtcatcctgcagtcgtgaaaggatgaggactgaaatccgtgaaggtgaaatttcttgtttgaacagtgtgactgatcagactttaactctgtgcttagtgccatatattaaaatagagaacatcagccaggcacagtggcatagacctatagtcccagctacttgagaggctgaggcaggaaaatcacttaagcccaggagttccaggctgtagtatgccatgatcacacctgtgaattgccactgcactccatcctggacaacataaactccatctcttaaaaaaaaatagagcatatggcgcctgtagtcccatctgctcagaggctgagacacgagaatcacttgaacccgggaggtgaaggttgcagggagccacaatcacaccaccgcactccagcctgggcgactgagtgaaactccatctcaaaaaaaaaaaaaaaaaaaaaaaaaaagagtatgtatgtgtgtgtatatataaaatagagtgtatatatatatatatatagagagagagagagatttaaaagaatcaataggattctttggttgcaattaaaaaaaattaaaaaggagagtgtattgcaagttgagggtgggggctgctcacagagttgaaggggaagttaaataatcaagcagaaaggccaagctcagaaaaggccagagctagatcagctcttgggtcgctggcaaggagttatagctggtttttgctgagtaccactatcttcatgaatgagcaacaaccattttcagattcattttcattttccaaaagaaccaaataccaggcgaaaagttttgcattgatttgggttagcatgtgactacatcagggtgaggaaccttaactgacaatcccaccagtcaatctctaataaggtaagtcccttaaaaatatatcttaaacgagacttaaaaaggactaaccataaaggaaaaaattgataaattaaaccacatgtaaattaagaatgtctattaagcaaaagccaccattaagaaagttaaaggcaagctgcagcataagaggaggagatatttgcaataaatacataataacaaagaaatcaaatcctgaatatataaaaaaaacttctatagatcaacaagaagacagcagaccacccaatggacaaaagccttgaaaaggtacttcacaaaggaggctatccaaatggccaataaacatatgaaaaggtatacaccttcagtgttcatcagtgaaagttcagtaaaatccacaatataacacaccacacacccaccgtcatagctcaaatgaaaataacaggcagtatccagtgttggtaaaaatgtagaacaaccagaacacatatacacagtgggtgggagtgtaaattggcatagtcgctttgcatatccagtgagagagcagttctgctcctgagtacccaagacagaagcaagcatgtgtgcatcaaaggcatgtgcaagaatattcatagaagcctggctctcaaatgtccatcgacactaacatggataaattgtgtcacattcacacaattgaatacgatgcagaaatgcaaactaacacatcacatgtaatgaaatgaatgaatctcatgaacataaagagaacatactatatgaattcatttatctaagttcaaaaacaagcacgttacagtatggtgttaggagtcagaataattgttaccctgggggaagaggtagttagtgataggaagggggtacaaaggggtcttctggggatctgtcttttgagatagtgaattacctacatgtcttcactttgtaaaaagctattgaactttaaacttatgatttatgttattttctgtgtattttatactttttaaaaagtttgccaaaaaaacagaataacaagaaaggctaaagtaacaatgcctgggtttgaatcctgattccatccctccctcccttccttccttttttcctgtgacagtctcactctgtcacccaggctggagtgcagtggcgcgatcttggctcactgcaacccccgcctcccaggctcaagcaattctcatgcctcagcctcctgagtagctgagattcatcacaggcctgtttcatcacacccagctaatttttgatattttttgtggagacagggtttcaccatgttggccaggctggtcttgaactcctgacctcaagcaatccacctgcctcggcctcccaaagtgctaggattacaagcatgagccaccatgcccggccctgattccatctctaacagcgtgagcttgggcaagttacttaacttttttgtgctttagttttgtcatctgtaagagggagataagagcagtacctacctcacagggttgttgaaaggatcaaaggagataatccacgtaaagtgcttgaaacagtgtcagatacacagtaaccagaaaataactcttaagtagatacactttacagtggctcctccataataggtgtgtgggggaatctaaaaatgtacaaaaccctggtctcaaggaggttttaatcataattagaaagatgagatacgtaaaagaacaactatttgactctacaagagagtattgggaaattccaaatgagcgatgccgataagaaaatcagaggaatttggtggaaggagtgattactgtagtttagagtgttctgggcaaaactcatgccgttgttaaaagtcaggatagtcattattcacggtcggggaagaggttggtcaggagcacaaaggcaattgtttcttgatctgggtgctggttacatgcatgtgctcaactgtgaaaatatatggagctacgatatgtgcacttttctgtatatgcgttctacttcaaggaggttaaaagggcattggtttcgaaacctggttgatatttgaccataggcatgttatgtaagctctatgagtttcattttcctcacatataaactgtaaatatacctccccttgggttgtcatagggttaatgaaggcaaaatccagtccaggatgggacagtaaaatatttcatgtacctgatctgctcactgaggaagagggtgacaaacggaagcagacccttcctgtgttaagatttggagcctctctctggggttcattgctttgttggaagaatgacctcatgtcattattgatgttgtgaatggaacctgtttcagtgtgtcactgtggtggcgcaatgactcagccactggggcaaagggcacttctgcctgtcagggccactgcttgacacttgtcccacaccaccactgttggtttcctttttctgtgcttagtcatagccacacctgcaagtgtgcacaatgcttgatccaggtgtgcacttagtaaatatttactgagtgcctgctgtgtgtcaggctctgatggagcatataataatgactaaaagcagagtaaaagtaaaacaacataacacattgaaggcttgcccttcaaatattttggtctactaacaaggtagacatgtttcttctgaaagctacttttccccgtctcttcccttctttctctctgcttatcctctgctcacccaatacacattttcttattctcattctcatttgtattcattatctcttttacacacacacacacacacacacacaccccccacacatgtacaccctcactgaactccattccatataatcagtctaacagccatttaacaaaagcaatcaactcagcaaatatttttctacttgttcctgcccctccaaactatagatggcagtgccttacattaattatagcagaaacaatcattaagtgttcattctgtgtacggcaccatgtcaggtacttgcccacatcatctgtaattctcacaacatcctgcagggcatcgttatcccatttgataggtgagggacctgaggcttacagatcttatataattttcccactgtcccctacagcctgtttgtggcacagcacaagtccgctgtctcttgacatgctgtattccttgtggagacatttgcagtgtcctctctgatgattaaatgatgtaaacaccctctgtatcagtttgtcatgcaatcaactttatatgcaaagctgtgtattagcagaagttgccactatggattctgacaccatggtcattctcttactttaatgagtgtagtttgactagaaatgtcagtatagaaccagtcagccttgcaaacactttctgagttgttgcataaatgctttaacattcagaagcactaacctgctgcaccatccgaagggatactgagcctatttcgttatctatattaaaatcttggatccaagtgagactttccatcactacaggaagagcctgtgtgtattgagaaagttctgccattttgggccttctttattagactgtctctcttagactactttaacacttattgttagcctctgttccagaaatttgtagacagataggggtatctgatgctgattaaagtgagtattgctgtaagctgggcacagaggggcagctgatatggtgcatgcttacaaatgctgttctaaatggttttccacagacaggcacagtccagagtggctactactcccattagtcctgatgtttttgtgtcctcgcctccagccttctaataaaccactctgattgggacagccaactgccctcagtgcacagtgtcatgttatgcattggggcttgagtcatattcaagtgaggagggaggtcaaagctagcaaatcaccatgggcttaagatctaggcttaagctgtttagcctcagaaacttaatattattgtattgagaagcaagcatttctggagattgacaaatctacaataggagatgtatattgggcaatatgactaataacagttatttgttcaaaaactaaaagctactaaaaatggagtttcctctgcatgggctcagttctttacatgtattttttccagttctcacaacaacccttcaagtttttgagtaattattcacatttcacaaatgtgaatactgagctggcatcccaaccagatgtatttacttccaaatcttgagcacgttccactctgtctcaatgtcttcagacattctctctgctagtatatcacccaactgaaatgtcagctcctttgccagtttggcttcaactatcccaggcagaattactggtcatttcctcttttgggttcacacagcactttttatatacccataagaacactttgtgttgtattgtaattgcttttgctgtattgtggttgttggtttatttgcctgttgcctctgctagtctctgaacttcttaaaggtagtgacaaagtcttattccttcttttacatttagcttgtcataggacctggcagtgttgtgtagtgtggaaggactgagtttaaatcttgtgtcttttttggctgacattatgtttttcggacatggtttactgcctagtaacaaatagagtatgttcaataaatattgaatgagagaatataatcttagatattattttttctctattaattatttctattattaaagctgaaggataaaaatatcttccttatggggttggtgtgagattaaatgaatgaatcaaacctggagaaatgatggtgcaatagtaacttctgagattcagagaatggttatgagattcgtcatgttgttgcatatataaatggtcattttatttttattgctatagtggtattctatgatatgaatatgatactctttgcttattcattctcctattgataggcatttggggtgtttccaggttttcactattattaataaagctgctgtgaacattcttgaacaagtctatttgtagacatatttttcatttctcttgagaacaaacataggagtagaattgttgggtcataaagtaggtgaatgtttaaatttatcatttaaaccatttttaactgccaaaccatttttaaatgtgattttaccattttatactctcaccaatgacgcacgagagtcctagttgctccacatctttgttcacatttgatattatcatgggagtatttaggatctcattatagcttaatttgtacttgcctggtgtctgatgatgctgagcaccttttcatgtgctatctagccatttatatagtttcgttgtggcctactgaggtgtttgtatttttattattgatttctgggagttatgtattcttttatcagtggcttgccttttaacttttttactgatgtcttgataaattgatgaagtacaatttatttatattttttcttttatggttagcgcctcttgtgtcctaagaaatttttgcctaccctaaggtcatggagatatttttctatgttttcctctagaagctttatagttttggctttcttgtagatctgtgatccctttcagattaatttttagacagagagagagaaggaagggtaaaggtctactttttctgtatggatatctagttgctccaggatgttttattgagaactttttttcttgaattccatggcatctttgcccaaactcaagtgactttacatgcgtgggtccacttctacactcttcattttgttccattaacttatttatctttcctatgagattgtcttaattactgaaactttatagtcaatcttgaaatttggtagttttgagtcctacaacatttttcttctttgagattgtcttggtgattgataggctttgatagaaattgaccaactatcaaaaaaatttttttaagcctgggagtttttattggaatcatattgattctatagatcaatttaaaaaaaaaaaaaattttttttccatcttaacaattttgagttttcaaatccatgaacatgaaatctctccatttatttaggccttctttaacttctctcaacagtgaagaggccttacacatcttttattaagtttacttctatgtagttgatatttttatgctatagtaaacaatatttttagaggtcttatttccagttgacttgttactagtattttaatatataattgagtttttaaagaatgactttgtatcctgaggacttgctgtattcagttttacaattatttttacttttgttaagaaggttgataaaggaaaaactgaaaacagcaacagcccaaaatgctcataagttagccacagggctcaacctctttcttttactttttattcctttttcttgccttgttgcaatgcctaaggactccattacaacgctgaataggtgagactgggaggaacactttcaatatttcaccattgtgatgttagctgagggttttctttttgtatatgccctttatcaggttgaggaagttcccttccattcttagtatggtgataatagtattactattacagttaatgtaagttaaattttaccatactttttctacctttattgagatagtctcacatatatgtttgtataacacgttaattctgtgcatgtatgggtaacttctgcaatattcctggtggatgcagaagagttgcctaagacaagcccaggcatgtggtttaaagtgaccaccatgattctagtaccaaatacagtttggtgtcacttgatctgagccatgtggctagaacttatgagtgttttgggctgttgctattttcagtttttcctttatcaaccttcttaacaaaacagatgtctcttattttggtggtagaggtgggactttgggtactttttatgtcgttctcttgtctgtattttctaaatttctttagtgacatggatgaattgtgttttaaaaagttttaaaattctatataattaattagattacagattaatacacttcaaacacatttctaccaagtctttctaaaattatatccaactcaccttgcttggatatgggtgtttcttaaatctctgagagcaacatattcacaaaccatttcgtggtgggtgactaaggatttctctgttgatcctttaatcatttaattttagaaggtgctcattttttcatctgtcccaacttcagtttcctggatgaaactcctagcatggttctgttcaacatgcttttctgtagtttctcttccttgggaacttaccagagcaggaaaataaacaccaacagattgtgtgtgtcatgacagaggtatatagatcagggatttcagccgcgcttgggaatttaatgacttgcaacagatggagtctgagtccagggtgactttgctcaggggtaattcttagtaagtttggcttttaaattctgtgattccccccccccatctgaagcagttgaggctttagaggcctggagctagaggaagcctccctcagactagtctgtggatgacagccctaggatgtggaatagggattggagatagactgttatttccagctgctgtgctttgtttttgtggaacaggaagtcattatctggagattcacaatttcttgatagctcatttctccttcctggaagggcacccgcatctagaataggcttcatcgctggaattatagagcccccacaaggagctctatttgactcctttttttctttctaattacagattcctgatagaaggaatgttttctcctctttctcagtacttaatgtgcatggcaataaatatcagttattattatttttcttttgagacagagttttgctcttgttgcccaggctggagtgcaatggcgccatcttggctcaccacaacctctgcctcccaggttcaagcgattctcctgcctcagcctcccgagtagctgggagtacaggcatgcgccccaaacccatctaattttgtatttttagtagaaatggggtttctccatgttggtcaggctggtctcaaactcctgacctcaggtgatctgcccgtctcggcctcccgaagtgctgggattacaggcgtgagccactgtgcccagctggccagttatttttattactttctattgattattaaagttagaaagttttatactatacgaagcaaaacaaacctcaaacctcaaaatgaatgaataagtgctccttgtcattttttaccagtaataatgaaaataatttaaatcatatagcatgccatattttacagtagcattcacatgtcttatttggtcctcacaaccatattgtggggcataggaaatatcattatcctccttaaaagtgaggaaacagactcagaaattgagaaatttgctcaagattggacagttctaacaatgtagagctacagtccaaatgctgcagtataccagagtggttaagactaagggttgccaactcagacctcttgggttcagatcctagctcttcctcttactagctttgtaactttggccatgtcacctaacctctgtgccttagtgtccccccttactaaaatagaggtaatggagacttacctcatacagatgtctcctagatcaaatgagatcattttggtatagctctagacagaccagctggcatacagtacctggttggtgagggtcagccaggccactacttgtcttggaggcagcggtggtagatttttatctttccgtccttccagctacctctcctgccttgaaacctgaagtcaactccaggagtcaccaaagtgcctgacacactccggaagtccccaagggccctgtagggttagagaatccaaccccaaattaaatactttaaagaaaaactcataccataaagatctttttccttggttcagttttgccaggtggctgaagatggtatgtgcttatttcctcttacacaagcttaatcagaaatcttaagaaagttttagataggattgttacattcttcctctctaaatattttagggagtatttgttctttatttgccatcaacatttatcaaatgcatgctgacttgtgtatttgccacagtctgctcttgaagtagcatagaaattcctatgctatacagtacatgttcttaaaaagtctttgaggaagcaaccctctgtgttttatattgtgcaacctgccctacagttaagtaaggtttttgcttatgagtggggagacagttcatctttatgtcttttgcttgacttctctcatatatgcagagaaaaagagacaaagagaaaaagagacatatgccagtctgctgtgtgtctagctgcaaagggggttcgagcctatccctaggaaatgccctcaatgaaggatacaaaggttactatttttagagtggagggcagcatgtttgtcaacatttcatggtgtgtcacagccaggcaggaaactttagatttgaaaatagaagtcttgatcccattacctcatttttgtctactgaagtccctgactttaaatgtcaacaggaatcaaatttacttcataaaacaaatcatcagcattgatcgttctctatctagcaccacattttctcattacttttcacatatcctgtattccccactctgaggcagccagacgttgcatatatgtactaaaattaaatacatttaatgtcctgccctccaaactgttttagcatacacaatgctcatactaacagcttggttagatgttgccaacaactactgtacttactgtcttccacactgcctgttttgaatattgtcctatgagaattctcatcccaaaatactacggaaaaaatgtaggctctataactggatatgcagaataatccttatgttttagaactgtttatgtttatgaatgtgtacatagagtaagactgcttgaaggaaacacacattatgatggtgacattgattatctggggtagcagcaggatttaggtgctttttatgtgcttctgcaccttccaaattttctaacatataactagtttcttaaagttattaagaaatttaatttcttgatatttatagaaacaaacttatttattttagaacttggtgacttgaacatctgtaaaaccaatgtgctttgaaatgaattcatatgtgaatgccttagattcaatgtgccttaaatcttgagtcgttttcattggaggcaaagaatacttaactctatggccctaaggacagtgggggacaagtcacttgagtggcatctgccacttcaggacatataaaggtgcaagaatgttctagcctttccactttcccctattctgtggttacttgatttaatttcctttctcagaagttcttttggtatttaggagatcgttgaaaaagccatgacctctttcatctgatacataaccaagactctcaacgcagatccatagttggtatagacaagttttggtttaatagagctgtaaataaatgttccaagaatgctttctccatatttataatcttctatttcttttcttttcttttcttttttgagatggagtcttgctgtgtagcccaggctggagtgcaatggcacaatctcggctcactgcaacctctgcctcccgggttcaagccattctcctgcctcagcctccagagtagctgggactacaggtgcccgccaccacagccggctaattttttcgtatttttagtagagatggggtttcactgtgttagccaggatggtctcaatctcctgacctcgtgatccgcccacctcggcctcctaaagtgttgggattacaggcatgagccaccgtgcccggccctatgatcttctatttctaaaatgcaataactgcccacccggcacccacttaaacagcatgaggaatgcaggattgatttggaaccttgaattacctcaatgtctgaatagcaattgtaggccttaccatacagtggttgagcacttttgaatgtttagaagcatgttcacatgtgttatttcatatttgcttccaaacgaccctgtgaactagggcagggattaggattatttcatgttcccatgaggaaatggcacaaagaggcttgccttagacctcagtgagtttgtggtagagccaggactagaaataaaacctttcatcccatgactttatcaaaggccccacaattccagatgtctctttccaggatcttccccagggatacatggactctaaggaataatcatgataataataatatcaaaaataaaatgtttgctatatatacttcatatacattaactcagttctcacaacaatgtaagaggtaagtactattattatctcaataggccttagttgagggaatggaggcctagtacatttaagtaacttacacaaggtcacagagctagtaggtggagtagagtagccaagagatgaaccagcatggagccatagtccgtgctcttaaccacttgacaatgcggttaagtcctgtctgcttcccacctgtttatgcctaggttgacctaggccaaagatggaaattcttctggtaagggtcctaaaactccttttctccaaacttacagaagtatgtgtcttatattacttaagcaataagaatactgtcctatctccttgtggaaagaatcagggagagtaaagaggcataacaaaactgaaatatttttgctcaatagttagacaagattggaaggttctaggaatttatatctgccatggttgctgcaaggatcttttcatctatctcttgtctggctgctaaggagcttgaattgcaagtaacagaagccaattttactgtgagcgaaaataacttattctgaagacatagtagcttacagaagcaaaagaaaaactgaatacccaggcttcaggaagttggtgtatcagcttttactgtgttacaaccacctcaaaatttagtagctgaagaaaaaaacccaccatttgtttagcttatgattctgcaaatcagcaatctggtcagtgcttgagcattcccctacctgtgctaggctcagctgacctcctcagcagcccactcatgggtctgcagtcccatgagtagcctagttggctactatgtcttgattctccctatggtcattcatcccctggaagggtcactcacattatggtcttggagttccaagtatagcaaaagaaggcaagccccagtgcacaagcactcttctagtctctgcttaagatatatgtatttaatctcgactaaagcaaatcacatagccaagctcagagtcggagtgggaggcagctgcccaagagtacagatagagaaggaggaagaatctgtggccatttttgttatctcccacagatggccaggaaccttggcacctttaagactcaagtcaccagtcgagtgtggtgactcacgcctgtaatcccagcactttgggaggccgaggcaggtagatcacaaggtcaagagatcgagaccatcctggccaacatagtgaaaccccatctctactgaaaatacaaaaatcagttgggcgtggtggcacgctcctgcagtcccagctactcgggaggctgaggcaggagaatggcttaaacccaggaggcagaggttgcagtgagccaagatcgcaccactgcactccagcctgatgacggagcgagactccatctcaaaaaaaaaaaaaaaagacacaagtcagcaagaactaaggtgaaggcttcctagggtgccaccgtctgaataacttagcccccactatcttcctgcccttgagtcagtccatttaagatttccaaaaagaacctcactgtgcttgaattacatgcatcatggatggtgcaccttggttgacagtcaatgaagacttgagcaagacgggggagtccccaaaaggacaattgtgaagttgtaacccagatcagtgcggagggatgcagagaaggcaatacaatattccttctctctgtattgttcactatgttgactttgtcctttccctctgaaccatgttggtttaagaatttattaagggcaaaagtagtaatctcagcctgttacttgaacaacagaagatttcaaatattcaactcagaagacacttattataaaggtagtggtgctattagtccactgtcacactgctataaagaactgcccaagactgggtaatttataaaggaaagaggtttaattgacttacagttctgcggggttggggaggcctcaggaaacttacaaacatgatggaaggggaaccaaacacatccttcttcacatggtggcaggaaggagaagtgccaagcaaagtgggcaaaaccccttataaaaccatcagacctcatgagaactcacaatcatgagaacagcacaggggtaacttgcccccatcattcagttaactgccaccaggtccctccaatgacaagaggggattatgggaaccataagtcaagatgagatttggatggggacacagccaaaccatatcacctggcatgggtcaagatctcactgacctctcctctttttgtcattgctgcatatttattggataccaagtgtatagccaagaaagggactggactggtgttctgatgtgagataacatgatccttggccctggcagcaactccagcagttgtttgtttaaatcagttttagaatttgtgcagaattggaatgctggttttaagactttctagaaataaagaagggatggcagttaagtcgacatttagctgaagtccaagcaacaggcaaagcctaagataggctgttaccattgtcaccagggagctagagcacttaagattgaattattgcccaaataatagaaaggtttaaaggaataacagatccttcatatttgccaaaatacctttccctttggactgacaaccagggccatttttctggctataatagcctactcttacaaaggatagggaagaggtgatatccgtgtgtgtgtgtgtgtgtgtgtgtgtgtgtgtgtgtgtgtgtgtacccatgctaagtatttgaaacatgcctagtatactaagcattttctccacatgtttgatcaagtttctacaaaggtttaatcatgatcctctaatatatttagaataaatgtgttagtttattctaataaactaatttattagaataataaattaaactaaaactaataaatttattagtttattctaataaactaataaacatacaaacatactaggtgttttagttaatgttttgtaacataataaataaaaagtagaaacattgaaaagatgggttaaaaagtgaacaaaaatagaagttgtaaaatattttctttccataccccagtggatcaattgagtatctccttaagtctactgttccactttggggactgcttgtctagactgctaaaacgttttatacctgcccaacaattacaaagacatttctcagtaccagagggataatagaaagttgaacattctgccttgatcaaagtgtattcatgacttaatacttcctttatgtggtgaattcctgtacttctttggtatatccatactggctttgtgaatgtatatgtcttcatatacattctgtcttcataattgtacttcatacctgaagtacggactttcatatcccttgtagttctcaagtctttgaagtttatctctgcaataattacggaaaggtttggattcatggaaatcataacctgttctttctttctccaattcctttcttcattcttcctgtctcctttccttttttctctgttggattgataactaatataacttcaaaggcattttccctccctacttcctcctatcctgttttttgctgctttaagaattttgaaatgagacatatatatattcttcctgtgagagctaacatttattgagctatgtgccaggtgtatgctgggaattagttgttttcctgtttttctaagagattatcttaacttgatgtgtttacacttttataaactgcatctaccatcagtctgtgaggatgtcccctttgatcttggtaactaaaagagagttggacaagtactgaaatgaaatcaaattaccaactccaaatccaattgaaaagacaggcctactgcatacatgagctatttggttattttgttgtcagtgtcattgctggaaagtccacataaagaacatgagttttgggtaatacagatgaaaggggccatctgtagggatcctttcagcttgcagtacttgcccctaaccttcctgtgggtgatgctggtcagctgactgtatgcacccttacccccaacagacttcttgagtttctcctggaaatgatatagcacaacaaaggtaacaaacagaagatcgatgtgatacagactcagaacgcatcttcttctcctaattcccaggacacatgtacacaagcacatataataacatgcaagagatctcagctctctttctttgcccatatcaccagccccctgaccaacgttacagaatccccaacttgattgaagcagaaattctcatcactaaggttcaaaatgatcagactttgaatctggtagaatggcactattataactgtttcaggactgtgaaggcgaagactttgctgtgtgtgcttaaagtatgtttgcctatgaggctaagagacttctgagaaggtgagactagtgagactaccaagctccactctcagaataagtaggcataggtctgtgcccatacaatggaatataaaagtattatatataaagaggctgatgaggaccagctctgcagcagtgttactgatctgtaggactttagtgctggtgaaaagtagacccatatattgaaggaagcagtgagggagataatagacagagctattggtgagactgaaacctctaggtttatttcatttggccacttgacattctctttaaggcatagcttggctttctgttattcaccaacataaccaggaggataatcaagcccttgcccttgtataattcctgctgagtctgtcccacaaaccctggccaacggacggatggatgaaatgagtactcagacacaggtatgcagtgtaagagcagctaggggactggccggctctggtggccaaagtgcagccccgaggagctggagctgcttgctttttattcagtgcaggcacaatgccaaaaacctggagccaacacaaccagcaggtaattaacatttattgttcccctttcaaggaatgtcacacgcgcagatgataaaggtcagttcctggtcaacataagtaaataagcctgtttaagataaattcccccatactcccttgtacccactccttgccctctgcctcagggttatagaacagctgtcttcagctattctcccctggggctctgcagaaccttccgacctttcagaaggtttgcgtcctttccctatagtttttcccaccactgaccagtcccccacttattccctaatcttttataaatctggtccttttttctgtcttctaactattgcaacggtgagcctttaccttccgtggcaattccaggacctgagaatcatcttacaaagcctgaaactgatcttacttgctcacccaagggtgatgtggctgttagaaatgggtatctctgaccaaatgtaacatcagggttcagtcccatctaattccactttaggttctactgatacagcctagcccttcactaacatccaggaacctaattgttcctgaccccttcaaaggtccagaagcttcttggatcttgcaagcatcctgcgttgttgctggggtgtgttcacctggtgggcaggtgaatagtgaggatgtggaggtgcacatgagtgagacttctgtggcagagggcagtcctaatgagtcacctgtcctggtcacagtaagagtgtgggcattatagtcctgccactgcttctggggacttacccagtgctcctccaggaagtactttttctggctccccagccctggcatgggtataagaagtgtgctaaaatcagtaagaatggagacccccccaccctttttcccttgctcctatgatacattctcccttatggtacctgtagatataggacaccttctcttttaacctccgaaacaaaaagagcccccttttcacttcttttcataccatataggtgtttgatggtccattgagcagagcttcacatccaaaaggctgagctcctgcaaactccttggtttagttctctttgatcggctcataagtacagccatgccccacataacatttcagtcaacaacagaacacgtgtatgtcagtggtcctgtatgactctacaaccatatttttactgtaccttttctatgtttagatatctttgggtatacaaacgcttataattgcctgcagtattcagtacagtaacatgctgtacacgtttgtagcttaggagcaataggctataccatgcagcctcggagtatagtaggttatactatctaggtttgtgtaactacagtctatgatgatatactacctaggtgtgtgtaactacactctatctatgatgttcccacaatgaggaaatcaccattgttgatgcatttctcaggatacattcctgtcattaaccaacaatggcgatacactctacagttgaaaatgactatatttgagaataggaaggaaacaggtgctttttgctatggcaatataaaataaaacacagcttagggtctctgcaggtttcactatcactagttaactcttttcaagataccttgttatataaaatgttaaggaactaatttataaagcagaatactgatttttcagtttaccatagatgccagaatctatccctgccctcggcgtgagacctctgctggggaactggtgtttgccgtatcagaccacagcaaggtgtcgtaatggagtctctgcccaggctgagttggagaatggagccctcatctaagacagcccaagaaacggatatcagaaaggcacattgaggcagggaaccaataagccagttcagtcatagttggttgtcagaggaagaggccagaagtagggatccaaaggtagagtattggggagagcatggggaagtgggcaatggtaaaacagaggcagaagtttagaaccagagagaaaagatattcttggtcaccacgtgaggctgtaccccaccaacatggaataaactggggatagtcctggaccagtcaacaaacttaaagtctgatgcttgcttttctgagcaaaaaaaatgaaagctgggatgtgtcaggtcaggctgtcctaatggcagggagggagttggcagggcaggctgaaccagtcatttgaagaaggtgcgcagtactgcttcataggtcaccttagtaagtaaaaatgagaatgtggtgtcttgataaagattctgttaagtaatgttaagtggtagtttgatgaactggcttcttcactttgggaatatctctgaccaggtactttatttaccagcatcgaagcatcctccgtcctggacaatgctgagacagatgaatacacttatcctctggcgtcctctttatcattagtacgtatcatttgtaatgactaagtaggtcccagcgtagacttatcctccggctcctctttttatcatagtattttgttatgactaagtagattccagcatattttacgcacgttagaagctcccttgataagcttgatatgactaactcctcccttctctcaccctatacatttacacattagtgcatgacatcacttgaccttttgcccaaagacttctctatgtaaatagatgttaatccttaattaattaacttattttccctgttgaaaaatgttcctaagaagttgtgtcaagataactcttgccaatctcaaaaggtaatgggaaaaattcaccagattttagcttaatgaacaagcattaaggaaatactagagttactaaaaattaaaagcaggacttgacttctgatctcaacttggacagtttacttaaaattgctgacctcaggcttctctgtaaaatgaagaggtcaagttttactatttctgaaatctctccaagccccaaaattctgtgttcctcttttcacttaacaaattactgcataaatatgaaatacctactgtgtatctgtggctggttgtacagttttaagtacaggcatacatcagatatactgtaggtttggtttcagaccactgcaataaagcaaggattgcagtagagcaagtcacacatatttttttgtttcttagtacagataaaacttatgcttacactatactatagtctattagttgtgcaatagcattatgtgtaaacaatgtacatgctttaattaaaaccactttattactaaaagtgctaatgatcacctgagccttcagcaagacataatctttttctggtgaacagccttgcctcagggtggtggctgctgagggttggaatggccgtgacgatttcttaatgtaaaacaacaatgatgtttgctgcatcaattgacccttcctttcatgaaagatttgtctgtagtatgtgatgctatttgataacatttaacacactgtagaacatctttcagaattggagtcaatcctctcaaatcctgctgctgctttatcaactaagtttatgtaatattatttttaaacatattttcaatgtttacttattttatttttttgagacaaataaatggaaatggctctgtcacccaggctggagtgcagtggcgcagtctcggctcactgcaaccttcacctcctgggttcaagtgattctcctccctcagcctcatgagtggctgggactacaggtgcccgccaccatgcccagctaatttttgtatttttagtagagatggggttttgccatgttggccaggctggtctcggactcctgacctcaagtgatccacccgccttggcctcccaaaatgctgggattacaggcatgagccaccgcacccggcctcaacttttattttagattcagcaggtacatgtgcaggtttgttacatgggcatattacatgacatggaagtttggggtataaatgatcctgtcacccaggtagtaagcatagtacccaatctgtagtttttcagccctagtttatgtaatattctaaactctttgctgtcatttcaacagtgttcacagcatcttcaccaggagtagattctatctcaagaaaatactttattttctcatccataagatgcaactcctcatccattaaagttttatcatgaggccgagtgcagtggatcatgcttataatctgagcacttaggcaaaggcggaaggatagcttgagcccaggagtttgagaccctgttctccataaaaaggaaaaagaaaagttttatcatgagattacagcaattcagtcatatcttcaggtttcacttcttgttctctcactgtttctaccacatctgcagttatttcctccactgaagtcttgaactcctcaaagtcatccacaaggcttggaatcaacttttacaaactcctgtgaatgttaacttctctcatgaatcacagatgtttgtaatggcatctagaatgatgaatcctttccaggaggttgtcagtttactttgccccaatccatcagaggaattactatctatggcagccttacaaaatgtatttcttaaataagaagacttgaaaatcacaattactccttgatccatgggatagagaatggatgttgtgttccacggctgcaggcatgaaaacaacattaatctccttgtacatctctatcagtgctcttgggtggccaggtgcattgtcagtgcgtagtaatatttttggaaggaacctcttttttctgagcggtaggtctcaacctgggcttacaatattcagtaattcctgctgtaaacagatgcgttgtcatccgggctttgttcttccattgacagagcacaggcaaggtagatttgcataattcttaagggtgctaagattttttgaatggttaatgagcaatggcttcaacttaaagtcaccagccacattggccactagcaagagagtcagcctgtcctttgaagttttgaagccaggcattgacttttctctagctattaacatcctagatggcatcttcttccagtaaaaggctgttttatcttcagtgaaaatctgttgcttagtgtagccaccttcctcaattatattaggtaaatattttggataacttgttgcagcttctacattagcacttgctgtttgaccttctacttttatgctatggaaatggcttctttccttaaacctcatgaaccaacctctgctagctttatttatttatttattttttctgcaatttcctcacctctttccactttcatagaattgatgagaggtagggccttcctctgaattaggctctggcttaagagaatgttgtcactactttcttatcattcatgtgttcactgaagtggcacttttaatttcctttgagaagttttcctttgcattcacaactgggttaactggcatggaaggcctagcttttggcctgtctccgcttttgacatgccttgttcactaagcttactcatctctcactcttgattgaaagtaagagacatataactcttcatctgaatacttagaggccatagtgggattcttaattggcctaatttcaatattgctttgtctcagggaataaggaggcctgaagaagagagagagagagataggggaatggccagactgtggagcagcccagaacacacacattttattgattaagtttaccatcttatatgggcacagtttatggtgccccaaaacagttacaatagtatcatcaaagatcacagatcactgtaacagatataattatagtgaaaatgtttgaatgttgcgagaattaccaaaacgtgacccagagacagagtgagcacgtgctgttgtaaagatggtgctgacagactttgggttgccacagatcttctagtcataaaaaatgcagtatctgctgggtacagtggctcacgcctgtaatcccagcactctgggaggccgaggcgggcggatcatgaggtcaggagatcgagaccatcctggctaacacagtgaaaccccgtctctactaaaaatacaaaaattagccgggcgtggtggcaggcacctgtagtcccagctactcaggaggctgaggcaggagaatggcttgaacccgggaggcggaacttgcagtgagccgagatagcgccactgcattccagcttgggcaacacagcgagactccatctcaaaaaaaaaaaaaaaaaatgcagtatctgtaaagtgcagtacaaaaagacgaggtatgcctttatatgctgttatgtaacagtcactgctcttgcatgtttagaagcctgcagtgatgttagaacatttgttcttgccactcctaataaattccagtgaacatttgtcaatatggtttttttacaaattaggttaacaaataagggaaagaagatagtagagtctctatgttcaaaatgtagacaattttcctgccatagttcttactttttattcagttttagtggctttgactactactgaaatcactttatttaatttaatcttttaggagcttgaaatagattgcggcctaacattaaaagaatccaccacttctctttagtttgcatcagtaaagacactaggaacctcttaggtactggaaattttccctgtggtgtagactgagaacctaatccttacacatggcttttgtttggcagcagcccgactcataataaaaacaatttggaggtagccagtggaagggatagtaattaaaataatgctggagtttgggttttggttttattttaataaattagtaaattgaattgtggagaagaattagctttgtgatcaagatacttggtttttgcctatttcttactggagaaatttgccagcttttccccctctcattgtttccagtcccagccacaccagtcataattgtcttgggaaagatctaactgctgctttctcaatacagactatagctaagcactttgtttcctttctctaaggctaattagtagtaataataaagagatgttttgaacttttattataatgctatgttgctttattttgtaaggaacattgcagtttttgaaagaaagaatacagatttcgaattttttaaatcacctcttatcccatgagagatttgttttcacatcaaaatattacgagattattatattccaaagctttctaatacatacgtactttctataatgacacattatcattctagtagtagtagtagtagtagcagtagtactaagaacagcctacatctactgagcatttattatttgtctggtaggatttaatatttccctaatttaatatataggaaaactgagatagagggaaatttaagacttgcctagaatcacatatctaaaaagccgtaggtatggaattgaaacgcaggcaatttgactgcagattttaggtgtttcttgttattcactcaacaatatgtcctagtcaacttccgtgtgaattaacatgcatcaagagcatcatcttgacagctacatggaatttcattttaagggtatgaccactgatgtaactagtctcccattgttgggcattcaggttttttcatgtttttctgtgatagaagcattgctgtaataaacatcactgtgtacatcgttgcatgcttgtcctgttatttccttaggataaactcttagaatttatttcttacaattctcagatttctttaaataaattatttcatagaaaaacaaaatctcaatttcagaaattttacctatgccctgctaccatcccagagaataagttttaaaaatacatgcaattatgggacatgaaactgccaaagggaagataattttgtaacaaagtcttttgatattttttaatgactgtcagaaagaaaatagaatccctagaaattaattgaattcaaacatttcccttcaaatttaaagacacttgtttaatttgtattataactctaatgcttcaaaactgtttaggacttggcgtgatttaaactaacttggtttgaaaaggaatttattgtaagaaaatgatcttcagtagggacaaaggcctttttttctcttttcatttttggcttagaagatgagaagggctgttttgaggacaagattcccaacagaagggaatcctttggtggcaagtgtaaacagctttggcagaaagccgccctccaaagaaaaaggacttcagcttgttttaaactacagggtgagctccaagacaaaaaggataaccctgatgccaggggtgggccaatagagattgtttgggtggaaacactacatcacaaaggctctctagagctgcctcattagaagttgatgagttttgagatgtacccctttcccagttctctagacaggatcaattaccattccaaggaagtgattatatttcactcaggaccacaatgttccttttagactttgttaccaaaatgataaataaaatataaatactgtaagtgtaggttgtttcctgaccgttttcccttcgattttcagaaaattaatcacttatacaaaactggattcatgcttaatttgaaggagattctcatctttaatttaaaaatgctttagaatcctttttagtcactgtagatatagaaaatgcttttcgctcattttgtttctggggtgggtatggatatgtgtatatgtatatgcatactcgtgtttagcctacagcctacattttcttttcttttcttttttttttttttttgagacggagtttcgctctatcgctcagactggagtgcagtagcgccatctcggctcactgcaacctctgtctcccaggttcaagcacttctcctgcctccgcctcccgaatatctaggattacaggcttgtgccaccacgcccagctaatttttgtatttttagtagagacagggtttcaccatttttgccaggctggtcttgaactcctgacctcaagtgatctgcccgtcccggcctcccaaagtgctgcgattacaggcatgagccaccgtgcccggcctagcctacattttcaaacttacgttttcatttgagagaattgctatctgtttgaataaattacttggaaagatgggtgacaagccagcatcccatccttgtataattatgtgcaattatgtgcggcattgctgatgggtgtggttggatgtgatatgcatgaagatgtagtgaggtggtcagaaaactcagtcatttgagtatccatttccctttgattccaaacaactggccatagaaacagtgggtaggatggtagcagagatcccctatacccattcctgcagagacgtagagaatggaagagctactctaaagcaaagtttcttttctcacttatttaatcaaaaaaccttattgagtacctactatatgcacacatttgttgtctgtgctgttccttcatcagaattcattcctccttgctaaaagcctcatttcccctcccttcccacagccccagcagatacccacggtccttaggttactgaaaaagtttagatcttgccctcatcaaacccaagtcctgtatctctttccttgaaggccctgctaaagtggagttttatttgtaataacctttttatcataaaaaataaacttcgagatggaaaaatattttagagaaaaaaaggagattatatcatgagcattttctcctgatatactgcctacttgtaaacattttagtgggtgggtattattttattgtaggcttcaatttcttaacactcacccaattgttgaatatttaaaatatttttccctattataaataatgccaaaatggacatctctgttcttcaaacttggttcataatttagatttattttcttagggtagaattactaagtcattgtttattaacatgtgttaagatccttaatataaattgcccaatctcttttcagagcatctgttgcaacttagtttcactaagcatccacttagtgctcctattatggcacctttaccctcattgagcactaaaatctttcaaaatcttcactgattttttttttttcatttttcatttttgagacagagtctcgctctgttgcccaggctggagtgcagtggcacaatctccgctgacttctatctctgcctcctgggttcaagtgattctcctgcctcagcctcccaagccgctgggataacaggtgcctgccactacgcccagctaatttttttgtatttttagtagacattgggtttcaccacgttggccaggctggtgccgaattcctgacctcgtgatttgcccacctcggcctcccaaagtgctgggattacaggcatgagccactgtgcccggccatttttcttattactagtgagattcgatatttttcacatacttactagacattttttagtttctctttcatgagttgtctatgttctttactcagacttcttttggggtttttgtgtttttcttattcacatgtatgaacctactgaatattaagaaggttaactgtttgtctttaatatttattcattatgtttaggctaaaatccctccaagaatattatttataatcatattatcacttacagacgataacttggtttttttcagtgagatgagcttatatcattttatataggagatggctttcaatgtttaaaaattaagaacacattcctcaaagctaagtacagaacacatctattccagaagcttttataaaataaggaagagtatataaattgcaagagaccttggtactaccagtcaatacttctgtattgatatagccattgggttcttattgcacttaatgcgatagctcctctggggtgctcattacagaattgtgagatctatgcccagactaagcacttgaaacagataatgagctgctttggaatgtactggattccagttaaaattctagtaatccctcattcctatacttcagttttccttacctctagagcccctgaacagtagctcatatgttctccttttccttttagacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcaggtgggtggtggttcctcttctgtgaaaacaaacatacagttgtgaaaaagctgagatcaaagttccacatcctgtatgaagtgcttgtttttgctgtgtgatgggagtggtgatggagggggagtgggaccagaaaagtaaaaataattgagcaaggtaagtaatgcgtatagtgacccagttcactctgtcttttcaccctctcattatcacacatcttccataaaactagggattattcttctcagctgagctgctaagcagcttttcagggcagcttctgaatttatattctttggggactcattaacgtattagctgtggtgctggaagtgattcatttctagatggcttctgaagagacatctttctcacactgccctcgatgtaggtaaaagggccagtttatggccaatcatggacaatacactgagaggttaattttacgactccagctaccctgtgcagggtctgttagtcataatatctcacattcagactttggctctgggactgggggatgggaaagaaaagtggccttcaatcagactgaagatccagctaggacatgaatttctaaaagggccagaagtctagcagacaaaatataaagaaaagaatgttttatttagacaaacaaaaaaatgcttaccagccctagctgggctgctcgcagctatcagggatgcttttgtgcttgagtgagtccagaaggcaattacttcccccgtgggtcccgtgagatttagtgaaatgacaaaatgagggagcagtcaaaccagcactaatacacatatttcttagagtatgtctgggtgaccccaatggtaggcagcaagcccatgatcttgtaagccattaaaccccttcttttcttgtttagaatacattttgcccatctgttaacgaaagtggatacgctagctgagcaaaaaggataaggtttggaaaaactcttgagtgaaatggctttctcttatgtggctatcctttcttagattctcactataaatcgtagcagtgtgttaagagtcttcctctcccgctctgagtgtggagtgtctgtattattatatcctaagtgtaatgcaatgtgacggccgacggcagtataatcgggccagctccccaggcagtccagggagtggacacacaccagggcattctgtatcagacactgggtgtagctatgcaaactgaagagacaattggatctctgtgtttgaggctggatttgctactccctacttctaaactgacagaatttttaaaaccaagtgttcctctctgtgcctgcttattcatttcccctgaaatcagcactgtcttctgctggtggtagcactgtaacttctaccttatccacggggcccctctgaattgacagaggaagagagaaaaccctgaactctcctttgacacggaagcccttggaaagagacaaccatggaattaccggattttcaagctggaagggaccttgaataacttagtcaagttatttatagatgagaaaattaaggtcgggaaggtgatgtgacgtatctagagagtcatgcagtcacatccagggtccttttcttaatatatcactggtgcctcctggtagatgaagccaaatagacacaaatattgaaataatttccaccagaagaacagatatttgcagtttttccagtatgtacaaacgtatctatttgtttcaaagtgatttctcccaaacatttaaaagtactgcatgaaggtttattattattattattataagcaacaaagacttatcggctaccctaagcaacaaaacaaattattggataggatagctcagagacctgaggaaaagactgatcaagagaagactttagacagacagcactagagtagctctggtcatagagactaatggatgtctcctcagcatgtagccttaggacaaatcatcacagactattttttgtttttgtttttttgtgtttgtttgtttgtttgtttttttgaaatgaagtctcgctgtgttgcccaggctgaagtgcagtggtgcgatcttggctcactgcaacttccacctcctggattcaagcgattctcctgcatcagtcttctgagtagctaaatttttgtatttttagtagagacaggttttcaccatgttggccagactggtctcaaactcctgacctcaggtgatccgcctgcctcgtactcccgaagtgctgggattacaggtctgaggcaccgcacctggccctattttttgtacttttgcaacttggctcaagagactaggggagaggagtgcattttgactgacgtgaccaccaagacaacatgtagcaccggggaagattatttcccaaaaggagagaaagaaaaagactgctaccagaagagagggaggatggatacaggacagggaaaaagcaaaaccaggccttcagcaaacactctccttaatgattcccagtggagagtgttctgttgcctcaagggcaagtaaatgcagcttatatgctgttttacatatctgtttccagattgctggaacctcgtttgtggaagatttttgaaatacagcacagcataaggatatctgttgatgtttcttacttaaatcctcacagccttgccccattactgattttgctgtcatggttatataacaatattttcaatagtgaaaccccataaagaggcttcttatacttctctagccagtggtatgtttccataccagttcaggaaatggacagcacccttttttggaaacttgaggtgtataggatctgaattccaggcagaatgtaagttctcactcattgctggtattcactgtgcccagctcctgccctcccttgcagtgttccatccgggaacccagagaattgatggttatctttcagtaatagccctttcctgggctctgctgtctaggtgttcagacagccctgggaaggtgctttgtacaggttattttttgtaatccttaaccttctttaaggaagctagggctcagctgaggtcaaaggccccgctgactggaagcctacttctcctcacacgttcctgcctacggtggccctgcatttccaggccccagtgggcagggcagtcaaaccccaggcagcagaggccagcaggtcagcaggtcagcacccttgtgttgctggcatccctagcctatagcaggcttgtcccagtcccagccaccaagagatcaagcagctacctttgaattccaacgtgactcccgccggcggggcccagcccagcctggcccagcccagccacatacgtgggcagctcccctctctgagctctccaaggacccctcctaccttcatcccaagagtttttcttaatcttagaaggcaccgaaacaagtcctgctgcttccacagatcatctgccaggaaataaaacattctgtcctgcataagtggctttctttgcaggaatcccccttctcattagaccaggtgaagggaaaacagtcccaatatgttcatccttgtatgggaaattttaaaaatctgaattttttgttgttgaattttctcaacctcatcaagggaaatgacagaatgtgtggacttatttaatgcattactatgaattaaaccataatagctttcaaaattgaacttccttaactgtccaccacccttacccatctgagagtcgatgctagaattctagtaaagaatgctgctttcagaatttgctgtgagtacactttggtggagtaaaaggagggaatcagttgtgtagaaaggaaagatttctccatattccaacaatgtgcaaaataagtgtaattagattaaaagagttgtccaagttgctattaaattaagagatgcatctgtatactttgttgtgatctaatttcacagcaatatattgagaagaatttaggacatagtttgaaggcagagtcatctctgaatcttatttccagctctaccacttaacggctgtgtgacctcgggcaatttacttaaccctctcagagaaacctaatttttttcatctataaaatagggttattaatatctagttcattcagaatgaaatgagataatgcttttaagggcttagtgcagtatctggcctgtaataaatgtcccataaatgatagctgtataattacatctgtggcacacaatttaaaaacattgagtggattcattttcaattactttaatttttactgttatatgtatcttaaattcttttctgaaaatcagtgcaaatttttcaatattccaaagcattactctttagaaataaccactgaaatatgttacgtttgtgaaacagagcaaaacaaatacttcactatctaatgttttccttggagagcgggtgtgtatgtccttactctctgagattgaaaagtcctagccagaccaataaagaacattggaattgtttgtttgtggaaactgggataactaaggggctgtttcagttacataattaaggcaaggtcatttcatgttgtttatctatagctagttgctatatgggggttcttacagctcaatccctctctacccctgtcaccctgcaaacttggtcttctgttttggggaccatgaggttataactcagacaaagtggttaagaacactctggagtcagactgctaggttcagttgttttttgttttttgttttgagacggagtctcacactgtcacccgtgctggagtgcagcggcgcaatcttggctcactgcaagctctgcctcccaggttcacaccattctcctgcctcagcctcccgagtagctgggactacaggcgcccgccaccacgcccggctaattttttgtatttttagtagagacggggtttcaccattttagcaggatggtctcgatctcctgacctcgtgatccacctgcctcggcctcccgctaggttcagtttttagctctgccactttctagctgtgactgtgggtagctcattttacctccctaagccttagcttcctcgactataaaatgaaggtaacattctgacctgaaagatcatactgaagactcaaagagagaatctgtataaaagatttaacatagaagaaggcatagggtacttcaatgtttcctgtatggcaggtgaatgacaatgatgtttcagtggttatagtcacagcagtaagctctctttttcctcaaaaatctcaataacaattctcaagtaaaaatcaaacccaaagtttgccatcacgagtatagtggagttacccatagatgtatagaattaaggagcagcaagggactgtgcctggcattgcccagcccaccctgttgtacttctccctctttatcccttgtaccctaatctccccactttacagaggaggaattgaggcctggagagtataaaggacttgagggcaggagctctgctgcttagcaggggagctggaagtccaacccaggtgttctgctggttggtgttttgtccagtgttccatatgcttccctaatatctatgtgctatttataaagtccttgtcatttacatatatcatttacccgcaaaagcatgccaaaagcattttgaaagtatgaaatactattaagaaaatcaattcattcttcaaaggaaagcaatgatttgctccaggaagctgtcattggtattttattaggtgctaagtgctgatcccttccattccattcttcacatccttaccccttatttcttagtgttggggctgtgttcacatatcactctcacttgagcaggcaggatggcccctgtttctcaggccttgggttttattgctaggataccaggctgctagaatccgatggagttatatcgaggggctgaggcatacaggagcgtgaattctgctgagccgggcggatcctcgtgctcaacactggaccctctgaaaggctgccgggtgccgagcccacaggcctcctttattaccaaagtggctcctttggctgctccttccactttctccccaaataatctgatctctcgattgtctttctttcatagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccaggtagccttgggaagcatctggctaatgcttccaactccatttgttcaccccactaccctccccctcttattccttttagccatgcttactatgttcgcctggtaacctcttactgccttagaggaagttcaccatacatagctgtgggtgcgtctgctctgatttaaatgcataatctggctagtggatgagagaaaggttggaaaaaaataaagaggctcatcaaagaggagaatataatgtctttctgtcattatgagcaatgacaacaaaaagaataatgggggccaggcacagtggctcacacctgtaatcccagcactttgggaggtggaggtgggctgattacttgagttcaggagttcaagaccagcctggccaacatggcgaaaccccatctctataaaaagtacaaaattagccgggcatggtggcctgtgcatgtagtccagctactcaggagactgaggtgggaggatcacttgactctgggaggttgagctgcagtgagccatgattgcaccactgtactccagcctgagtgacagagcgagactgtgtctcaaaaaaagaaaaagagtaatggggtaaaggaattgttattattcatttgcaatataatttatgtcacagagtagtgagcttggaaatggaggggagaaaatgctatcccaaagcatatgcttcagttagagttgatgaagtggacctgaacaaagttaggacacacatgacctgggtactgggctataacaggacaaaactcaaaagccaagcaaatgtttataatagtaacagggtcagggctgtggaaggaatcataaaagttggagttttctgacataaatagaaagtgatactttcctggggagttagaaattcaataggagattaaatgccaacgattggaaaaggagtttgttaaagaaggattttgcaaagtggttttctatttataataatatccttggatttatatggtgatttattgttcctctaaatgtttccttagctgtgtgggctaaaatatttaactaccaaaaggaacaaacactccatcttgtggctaggaaaaaaatagcacctccctcaaacctgactgttgtgtgttgaatcattaccctgtaggtcaagcgtcataaatatccagagtggtgctgagaggagcaacctgaaccctgagctcaaagaattccttgcctgagctatcaaagatttcggttgagatgtattactttcaaagattaatctgttaatttcttgataattacagtgacagtattttgcagaagatattgcagaactgtaaacattccagtatttatcagttcggaggttttctaaagagagaaagtactggaggtggccgggtgctgtggctcatggctgtaatcccagacctttgggaggccaaggcaggtggatcatttgaggtcaggaattcaagaacagcctggccaatatggtgaaaccctgtccctactaaaaattcaaaaattagccaggcgcagtggtgcgtgcctgtaatcttagctactctggaggatgaggcaggagaatcacttgagcccgggaagtggaggttgcggtgagctgtgagccaagattgtgccagtgcactccggtctgagtaacagaatgagaccctgtctcaaaaaaagaaaaaaacaagtattgagggggtacaaacagtcaattacaaagaaattcattcatttgataaatctttgtcgattgcccactgtattcctacattattgcataaaatattgaacaagatcctgcccatgtcttgtggagcccatggtatagtggagccagacaggtgtgcaagatacggtggaaatattcacagagagaagtacctaagtctacttaataagtcaaaaatagcttcacagaaggggtgatctttgaccaaatgtacaaggcaaagaataagaattttcctggtggaccatgagggaaagggaattacagaccagttaaagaacatgtgcaaagagagagacatgatatactcagggccagtagctccaatgtggctaacgcccaaaatgttagcaaaattataagaaatttcaaagtacctatggagttttggtttacttatttatttgcatgctttttctcttctttttgatctttatctccaacttctattcttggcaggtggaaattgagcaaaaaaagagtttgaagccggactttgaaggagatgaaatggaaaatcccaaggagtgtggagtgcagtgacaaagccttgcggcaaggaatcctgatcccagagtcatgatagggtgtcttcctgagtcatgatagggtgtcttcctgagtagctgaagttgcagtcaatacctgctgtggccactgcatgttgggaacagtataccagatcttcctgtttgcagttacttgtattttaccaggaaaccctgagaatggtggcttttggagaggctctttgattctggtcatgcctaaagcacgaggttcacctgactgttggagcttactgtataattaagcctccttgtcttgtctctgcttatctcacagcactggtatgtggtttgttgtgactgttacagtcaggaaaagaacctcccacatcagtgttagcacgattgccttctgatgttcatctgtcactcgcataactttctggcaaaggcagtcttgagaagttaattaagaatccatctctttcactctgtctagaaaaggttcagaaaaggtgcaaaacaaatttcctctttgggtcttactagacctttttgaggtgtctccattctttaactgttaagctttcaagacatttccctcctggctctagatcgtttagattggaacactttttccatctctctaaggtttcagtcacaggatttgctatcctgagtcacaatagacaatggaaaaaggcacaataggagactttttaattttgtgaatggacccacattctgcaaaatgggtgttgaggggaaggcaaaattaatcttagttttcttcattttggagaaaagagacattaaatataagatgatgttcagttcaagaggtagattcaatctcagtgaattcccaaattcacactgaaaaatacagtccacttctgattcctgaaacaaatatacataatacctgaggcatttgtaaggggcatttgggagttctttttatacctcatgaccaatagacagttgcatgtccctttaacccaactttataggaaatttaagctgcaaagataatttttaaagctgttttaaaattaagcttgaatgagctttcccccaaaattcagagtttgataatcacagtattggattggattgaaaaggcatctctagggtagagacgtggaaaagccatatttttctaatgttgggaacattatattctgattccaagagtcagaacgctcactccatcttctttttcttcatctgtttctgggacaattaatcttcttttccttcatccgttcctactcacctctgcttcttatttgtatcttagtgttttctcccatgaagaatacaagtcgggggacagaaagcacacttcattggatttgtagatgatgcagaaatgaaaaatatctccagtttttggctgatggattcaagattaatgtattcaatgaacaatcattggagtctaaatgtgtattgacactgggatatagaaatagttacagtattttgaaatatctgaactaagactgaaagtaaaatgatgattgaataggcattaatgagaaaccctatattctgggtttttaaaatgcaaccctctaagtacagagtggagtgtgtgtttgtggatgtgtgtgtttgtgtgtgtttatgtgtgtggtgttgatgggaacggtgttaggaagacctggtttcacggtagtttatagagaaatatttccttacagaaatggaggttcaatgttgaatcagaaatatatcatggctattcacaaagctaatgtagtcagctggtgttaataaaagccttacatgcttttattaaccctccatctagtccatatctaaatggagggttgagttcaattatgggtatcatattttaagagagacattaataagttgattgtgtccatagggaggtgaccagggttgtaaagggtctgatgatgcaagaacaagggagtagcttccctgaaggaacagaaggtatagctggaaagggagtgcagacaaggagggaatgatacaatagctgcctagaaatttctattgagctatgaaaaggaagaggaattagatttattctgtgtagcttcaaagggcaaaaataagaacaaagaggaactttacaggtgacaaatgtttgcttcaatataaggaagaattgtctaataagagttgttctaaagaggaatagactcaagttagtaagatttcctgttcctgtgaatgcccaacagttaaaataaccacctatcccacgtgctgtgaaagggaatcttacattggatttggtctatatgtctaccaagattccttctaaatataggtttagtctcaatagtaataagactctctaacttcatttgtctttttcttcataagtggtttttcatgctctttgaaatacagtggagttcctttgaggtttttgtcaaggaatttcaacgcatatctcttcccctgttgtactgaaggcttttgagattaattcctcatagaacatctaaatggattggagagttggcaagggaaatgaagctcatcccagcaccttccttagtcactcacgcttagcactctgtcaagatctctgcctcatctgctagcataacatgtggattgcttgttggagcttatttccccgccccccatggtaaattctcatttcctgtgtacatgcacctggacttttttgttttttttaccaagagttgggaaaaatcccttctatgctatctatattctgcaaacaaattattattattattattattgagacagagtattattattattattattattattattactgagacaaagtttcgctcttgtcgcccaggctggagtgcaatggcgtgatctcggctcattgcaacctctgcctcccaaatctcctgcctcagcctcctgagtagctgggattacaggcgcctgccaccatgcaccactaatttatgtatttttagtagagatggggtttcaccatgttggccaggctggtctcgaatgtctgacctcaggtgataagcctgcctcagtctcccaaagctctgggattacaggcgtgagccaccatgctggacccacaaattattattaatttttaaaaacctaacatcttaatttcatcaaatttgttttccctctactgtttttaggaaactgattatgggtagcatttaggggtttggggataataatactatatatttttagacgtaatgagtgttttactaggtttaaataacttctaaagaaaatacaagtgggcaaattagctatgtaataacctacatagaaaacagttgggcaaattacctgtggatatgcagattctacttttgcaaccctggacctggactttttattttttttttttgtggtcacaaataatctttgttatcaataatgtgaaaatattaaaaatgaattcattttaccagtacatagtattactcttagaacataaattagatatcacgtggtatcaagagctgtgctttcttttgagtctagggcctgctttttgactttacagcaaaaagataagaaatgtactcatgacatgtcagacaagacaatgtgaggcactttgtggggagaccattagatgatcccccttgcctgctcttgcagacatagtactagttattccttatcaaaagtttgcatttcattcatattaaatattatctggacagtttcattttttctatttggctcttcccttactgtgccttcctgcattattggcagggttcataatccttgagaacattgtttgatttaaaatattttttatttgaaatgagactgatttctattcaaatccagtggctgggagtaagagtttatttccctagaaacttatgtttctgataaatgggatccatgaaggcaaggactatatataattttttgtgtttccaacacctagcacaaagcttggaatataatagggttcagccaccttaaatgcttgccaggagggcaaacgtatactcatgaaataaaggaaaatgagtatgtattcaataaatgtttgctgaaagaatactgaccctgagactcgaaggctacttaacccttacttatcatcaaatactcataataaagccagcaagcatgcttttatttcctgaaggacttaaataattttgctttccttttactcctgcctccagagtcaagtaataaaacctgtcagcatttaggcacttaatatgctgctgaatttgaactacaatgtacctcattcacattgaaaaacatttttgtgccccaaagcatagtagcatagatgctgtccatagtcacggtgattgattgctttgttcctgcaagtcaaacagatccatgagcctgagccttgcccatttcaatggtcagtaggaaaagaaagcatttgatagagtgcacaaccagtcttcatgcagtaggtctttgttcttccagcactaaccgctgaccgttactttgcatttattttgtcaccacagtaagatggaggtctgagatagtaaggtcaaaatttgtgagataaagtcatgatttcagaggtgatatatatttcaccataagtttagtggtgggaaaacagaatgagctgaagttttttcttaaaagccttgggaatattaaattggtttaagtaggaagcactaccatccagcctgcttatagaaatgctcccagttcgagtggtaactttaactcttctaaaaatgaggattatatgttaattccagcatatctagaccttagtcagggaggtccaatcttttggcttccctgggccacataggaagaagaattgtcttgggtcacacataaaatacagtaacaacagctgatgagctttaaaaacatggccaaaaaatagcattttcttttttgtttttttttttttttttttttttgagacggagtctcagtctgtcacccaggctagagtgcagtggcacgacatcggctcactgcaacctccgcctcccgggttcaagtgattctcctgcctcaacctcccgagtagctgggactacaggcatgtgccaccacgcctgactaatttttgtatttttagtagagatgggatttcattatgttggccagctggtcttgaacttctgagctcaggtgatccacccgccttagcctcccagagtgctaggataacaggcatgagccgccgcgcctggccaaaatagcataatgttttaagaaagtttacgaatttgtcttgggccacattcaaaaccatcatgggccaagggttggacaagctagccttaggtcatgtccagaatgcaatttaacaggaatttcaagcaaaactaacaaaaaattaaatccacaaaaaaatatcatttggtaaatgcactgtctcacacactttactactaagtcccattcaaaccatgacgaccctttacataaaattagggcattctcaccaagtttctaaagatgatttctaaacattaccaaggtctaagtgctaattccccacaaaccatttcttatcttgtttaaatgagactggctttagatatcatgactcatatttatgtgtttaaggaattaaacgtgaaggagatgtataaggcaaccacaaatgtagaaaacaaatgtatgtattagtaatattctcccatgtattaactagaacaagaatgtgagatttttacatttcttctagtgtgccttagcaaatctgctggaaagagtctagttgttttgagaattgaaaaaaaaatgtgtctctcaatttgtcaattctaagcctgtaaaggcagaaactatccacagtaatgagtttggtagtgcctggagagaggcaaatgatcattggatgtaacaaaagctacaagagaatagactaaaaaaagaatttcaatatgaaaaagtaaaatctagagagatgacaaatcagcattgggtaccaagcctcaaaatacttgaactagaagccatctcttaaagttaaaagtaagaagctccaggaaaaataaagattgcatagtaaaaagggatagatggcaggattaattcaactcaacaaatatttatcaaatgtctactctggtcaggtgctgtgttagcagccagcttccctaaagggaggaaaggctagacacgaggacattgaggattgtttatttaaagtcactcataggcatgccataatggatttattaaggggaaattggggtttctgtgaatctttacaggacatagccatggagacaatcactatgttaagtaagttgctgttttcccaattgggcttcagtttcctgagacaaaaaagtgaggaagttggattaattgtttcttcaagtcctttccagctctaaagttgtgggttattttacaaaatatccattggtgccacctttcagtgactcttcctatgtttataagaaccaagaaatttaaattttgaagattggaaaaatcacctggtccatctttttccttttcacatctctctcttttttttttttttttttatcatttccccagacaacagaaacagacaaccttccaaatcctctatattgcagttgccttccacacacagatttaaaaagaggatcaaagagggtggtgaagatcaggtggaatgcttctttggaagttccactggcatcatctatcagaacaatggtgtgagcatgaagaggcacagacaggtctccaaaatagatgttaggatttgggtgctacctgacacagaagtaggtctaaccctccaagtactggggatgataggataatcaatgaggtatatatatatttgtcattttgtataaaatattgtgaaaattgaaggaggacactcagtaaacatcctgggactatttgtaagttatggcaaaaccagatgagagaaaagggacagtcccctctgtatcctcgttgtctcttagtaacatcaaattgtagttaaaaaaattttaaactatgtacaagctacaaaatagcatctctttcatggtatgtttgagtgtgtaattttagtttcttttctggttgtatttgtggtagtcagatgtgttggattgattccaactggacagagtaaggaattccagcatcctcttcctgcttgctcgtgttaccccacagatcaaaccctcaattctagttggggatgctgtctagccccacaccatgactgaagccttaagcactgttgcgcctccatgtgctttggatcagcaaccccagtggtattctaccagagcattgtgggaaagcagatgtatagtcaggtcccaacagcaaattgttgggtgtgagagttctaaagtataggggtgagggaagagaaggatatgaactcctctgaccttaagccagcattcatttaacttttatgtctacttaacaagagaacctggagaaaactaccgtattcaagagattaatcaaaatcagtgttttagccaggcgatgacagagaagcaccattcctcaccctccattcttgtaatgtctgtaataaatttcagtgcgtcaggatggatgaacccaagatccagtgaatgattcagctgttccaagccttacattttccatcattcatcatccattctcattcagtgtaacctcttgcactattgtggttaattttatgtaaaaccagtttatgtttttttttttttaatatgtgcctatgtaataaagtctacacactggctatctctgtagaggtgaggttttgtttttagttgttctactgattatatccttttctgagctatgaaaatgaattattaataaaaaatttttgaacaaaatatcactatgccaaatttaatgaagtcagacatatgaagagtaatgcttattaatataaggccagtcacccagcttgtatggttagtgatcataagctgacaaattaacaaatgacctgtttaattatcctagttaaatttgtcatagatataatttagtcaattcaagataggttggctggacccagtggctcatgcctgtaatcccagcactttgggaggctgaagtgggtggatcacgaggtcaagagatcgagataatcctggccaacatggtgaaaccccatctctactaaaaatacaaaattagccgagtgtggtggtgcatacctgtaatcccagctactcaggaggtcgaggcaggagaatcgcttgaacctgggaggcggaggttgcagtgagccgatgtcgtgcccacagcgtacctgtggtgtttggtgagagttggaagaaacacctcaatggagagttcggaaaactgtattctataaaacgaacgggatttgttgcagaagaaagaaaacattacactgtttatcctccccaacaccaagtcttcacctggacccagatgtgtgacataggaggtgtggaggttgtcatcctgggacaggatccatatcacagaccctatcaagctcacgaagctgctttagtgtccaaaggcctgtgcgatctctgcctagtttggaaaacatgtatgaagagctgcctacagacagatggttttgatcatcctggccatggagatttatctgggtgggccaaacaaggtgttctattcaccgtcttcactgtgcagagccatcaagccaattctcctgagagaggctgggagcatttgccaatgcagttgtgtcctggctaaatccgaactgaatggccttgtcttcttgctctgggctcttagaaggagggcattgccactgataggaggtggcagtgtgtactgcaggtggctcatctcttctgattgttggtgtatagagtgttctttggatgtagacacttattccaagaccaatgagctgctgcagaagtccagccagaagctcacagagtagaaggagctgtgatcctcaactgaggggtggtctgtctccattggtgtttttgagaagcttctgttaaagtatttgtcatttatgaagtcgaattgaaaatttctgaattaattcttaagtactttgcgtaagggggcaaagctttcattaaaacagccacgaagcaggctgcccaggaatggcagctttatccagccagatacagcaaaggctactctgtgaccaaatgtctttctctgcaacatggcttcagcccaaaatatgcaaacttctcagaagacaggtgaggtcaaatattcacttggctctcttcaccacctttacttttatgtttaaggggggagattgcactttttggtacagccctagtattgtacctgctgctactaggttttgcctggttagacttccagttacaaggtgttcgggtgtttttgcttagaaaggaacccttttcaatgccgggcgtggtggcgcatgcctgtaatcccagcactttgggaggccgaggcaggcagatcacgaggtcaggagatcgagatcatcctggctaacatggtgaaaacccgtctctactaaaaaaaaaaaaaaatacaaaacattagcccgtcgtggtggtgggcgcctgtagtcccacctactcgggaggctgaggcaggagaatggcgtgaacctgagaggcagagcttgcagtgagccaagattgtgccactgcactccagcctgggggacagagcgagactccgtctcaaaaaaaaagaaagaacccttttcccagcctggctggcattccagtcccagccaggcacactgcccccttgatcatttaaggagccctcaggcccctccataaaggaagcatgaggatgttctgcaggtttccagaaatctagcccagaaatcagggctcaatttcctgattgtaggggaggtgaagtttcctaagaaatactccgtggtatgagccttaacggatagacaggggctgagaaaagtgacctgggtcttgttattcttcggttgttttatggaataagcagtggaatttgaacaaggaagaagagaaaaggcatttttcttaaatgcggggatgagcttctcctagagttatcttgagttggggtttttaaggcagcacgaactgccaaatgctgtttttttgtggactgcaatcactttgcggtattttttcggcaacactgaaaagttttagttttttaaaaaaatacttatgcaaatatgtatatattttcacaattcgttttctatcttattttattttttttgagacagagtctctttctgttgcccaggctggagtgcagtagcgcgatctcggctcactgcaacctctgcctcccaggttcaagcgattctcctgcctcagcctcccaggtagctgggattacaggtgtgcactaccatgcccggctaatttttgtatttttagtagagacagcgtttcaccatgttggccaggctggtctcgaactcctgacctcaggtgatccacccacctcggcctcccaaaatgctgggattacaggcgtgagccactgcccctggcctccaattcgttttttaggagacagtctttattgttactgcacctccatccttgatcttgctagtgatgctgttttgctgttagctgggttagagttaatcctgtgctagtttggtaataaaagactgttgaagttgttttgttttgttttttaactgaatatcagacattattctttcttctacttctaaaaattttttcaagacagagtctcgctctatcacccaggatgcagtgaagtggcatgatcacagctcacttcagccttgacctcctgggctcaagtaaccctgccacctcaggctcccaagtagacgggactacaggtgacacctggctaattttaatttttattatggtagagatggggatcttactatatggcccaggctggtctcaaactcctgggctcaagcaatcctcctaccttggcctcccaaagtactgggactacagacgcgagccaccatgcccagccccattcctcctcctaaagttcattgaccataccttaaagagaaaatccctttcaaacgtctttctcctttggccctagcctgagtaaatgggctgactcctcaagttccagaccattgtctctttaactgctagaggaaaactgaaaactcttctgaaaatctcatctttaatggggattaaattctaaagtcaacactattgaaaataacataaattgcccataaagtagactaatggagtcttccttaatgaaagttgctctattttttagtacgttctcacaaggctataaagaactacctgaggtcaggcacagtggctcatgcctataatcccagtactttgggaggcgggggtgggcatattgcttgaggccaggagttcaagaccagcctggccaacgcatgtctactaaaaatataaaaactagctgggtgtggtggcacgtgcctgtaatcccagctactcaggaggctgaggcacaagaatcacttgaacccaggaggcagagattgcagtgagccaagaccatgccactgcactccagcctgggtgagagtgagactccgtctcaaaaaacagaaccacctgagactgggtaattcataaagaaaaaaggtttaattgactcacagttcagcagactgtatggaagcatggctgggaggcctcaggaaatgtacaatcttacagtcatggatggcagaaggcaaagaggaagcaagcctgtcttagcatggtagagcaggagagagcactaagcaggaagtgctacacacttttaaacaagcagatcttgtgagacctcactcattatcatgagaatagcaaggggaaaatccccctgccataatccaatcacctcccaccaggcccctcctccaacactgaagattataattcaacatgagatttgagtggggacacaagagccaaaccttattgttctatggccctcaattaatttttcagtttcttccttgatattgacagagtgatcaccaagtaaatcccagccacctgaacgatgtgttccagttcttggttagtgtggggaagtgagtaaaatgagtcacacaattattctgagttttaccaacgtgaattgactgcttctgacttgacatcatccttcacagacccactgagtggaatggcagacaaaataacttgatgggaggtaaaatgagtctccattatatgccacctttattaggcaaagtaatttttagttcattctatcttgtcctgtcatggacccattgaagaatttttacagacagaagagaaatctgccttaaatctccaaaaaagagctaacaaaaactcacaattttcttagcggtctcaaaagttacagataaaattttcagaaagcattaaggtccaaatacctatagtttcctgccctgccacagtctaggtcaatggacaggaacaggatacaacctattctccacctatagagagcaaacccaatgggtcatgaccttctcttccctcttttcctcccccttcctttaccctctctcttgtctcttctcttcttcactaacaggcatgaagtcctgagagcctagactaacctggtggcagcggcagagaaagggacatatcttagagatctgaaacagtcctcaattctatctgcccaggtcgattgctttttgcccacactcctattgcatatctcattggttgcctttaatacttgtgtgctgctttttaatgttttgtatttattagatttgtcctcctgattaaaaaagcaatagttaattaagagaattggctttctccgtgtgtggcaaagtacaccaaaaataatatgaatcagcaaacacaaatcaatgtgcaattaaaaatgacaaatttaattttgcattctaataaaactttcttgtaatcgcttgaagtcaatcccctgcttccattactggggatctgcagtctggaaagtcttctccctactgttgcttttctttctctttgcagctccaaggttagtgctgtcaggagtgctgcaagcatgtttccttctaatttgctggcagtaaaaaatctatcccctcttactcagtacacttctgtgaggagaaataggaaaaacaccaaagtacttttccccattcttactcggttcctcaatgcaacagttctgacaccaactctagaaatagaaaaaaaacaacacaagacgtatttttcttgttctctactctcacacagtcactcagcacttctggcaccaggtgtgtgggagtttttcgccagaaatcaagcaattctgcagtggattctgcaacagattctccagcggacagcagccaggtgtcctccagttcacgatccacctggagtgaacaggcaattctgacactatctacctggagatagcatcagatctcacgggttgaagggcttagttcccaacattgccctccacttcagatgccatggattgtggcccgtacttgtttctgaccaactggttataaataggggtttttagtactccttgctgggtttcagttaatttcctagagcagctcacagaacccagaaaaacactgttttctcatgttttataaagaatattacaaaggatacagataaataaccagatggaagagatgtatggggcaaagtgtgggagaaggagggcagagcgtccatgcccctacagaaacctccatatgttcagctacctagaagctctctgactccagtccttttaggtttttatgggagtttcatgatgcaggcatgattgattaaatcgttggcctttggtgatcaactcaaccttcagcccctcttccctccctctgagatcggggtatgaggctgagagtctcaaccctctaatcctgcctcagtctttccagtaaccagaccccaccctgaagctatctaggggcccccagccaccagtcgtatcattagcacctaaaagatacccttatcagtccatagattctaagggttttagaagctgtacgtcaggaaacaggaagaaggcccaatatttattttacaatatcacaacttctaataagggaatgacaactgcaatgaaaaagaaaggttctgcgcaaaggaagaatgcaagcacttagcgaccagactgaatggtggaacaaaggaaaaataatgatttagaaatgtggaacctggtcatgtttatcctataagtagcctatcaaaaaccctaatgtttttcttaaaaagttgctattttgctaccaaaataccaaataaaaagttctataccaatatatcctttcctaagatttttaaattatgaacttgatgagtacccaagacatcagtctgctgctcagtttaggaaaagctaacaagaaagtctatgatctgtcaataaaaacattaaaaaaattaaaagctgcataaccaaagaaaaataagagcaaaaccccaagacaccccacaaaggtgaacacttacttcttcttcttttatttttttgagacggagtctcattctgccgcccaggctgcagtgcagtggcgtgatctcggctcactgcaactcccgcctcctgggttcaagtgattctcctgcctcagcctcccaagtagctgggattacaagtgcacgccgccatgcccagctaatttttgtatttttagtagagacagggtttcaccatgttggccaggatggtctcaatctcttgaccttgtgatctgcccgacctggcctcccaaaatgctgagattacaggcgtgagccaccacgctcggccaacacttacttctaagtgaatgaaaggacctcatttctactcaaggtccttgacccttttccacaaatattcaagtaatgggatttctcctttcaggtagacgatgcatccattgaggaatgttctctgtggcaaggcagcatggtcaaatgggggatcgaattttgaaggcaatgtttttctcatctctgcaacccagaattgagttcggaaaagctaacaagaaagtctatgacttgtcaataaaagcatttttaaaaaattgaaagctgcataaccaaagaaaaataagagcaaaaccccaggacacgccacaaaggtgaagacttacttctaaatgaatgaaaggacctcatttctactcaagatccttggcccctttccaaaaatattcaagtaatgggatttctacttgcaggcagacagtgcttccatcggggaatgttctctgaggcaaggcaacatggtcaactagggatggaattttgaaggcaatgcttttctcatctctgcaacccagaattgagttatctgtgctctgagactttttctttataaaccatttaatgcttcaatgatggcaaagctaattcagcttcccaacagtgttacctctggaatcccacctcagggattttgtatcctctagatcttggcagtaaatttttggaagtacttgtttctggttagaagtatttttaatgtgccctgatagatatggagacagtatctccaaaagttgaccttcggaacaataagcatcatcctcatcatcacagtagcttgttgtagtgggccaagatcatgccactgcacagcctgggtgacagagcaagacagagcaagagccttccttttaactagtctctcctcttaacatattttattgcttctaattaaacataaggcacaaaatacatacattccactacaaaacctcttatcaaataaattttacatatttaacatttagcctgtgagttcctttgctagctcaatgtgctttcctctacattactcaacagtgacagcagcaatggccagcactctgctttgtgttttatgtgcattacttcatttaatccttgtaataaccctacaaaggagggttactaaacattttatacctgtaaatatcctcattttgcaggtatataaaaaaacaaaactgaagcacagaaggtcagttaatttgcccaacagtcataaagataatggtggaacttactgtctttatctctgcttctaatctttgtttaagctctcatctctggttttctgccacctacaggaaggttgtgagtgagtccattccatttcaggtgacagttataactagtatcttcggagcactctgtcatctttaggaataattgcagagcaatatagtagtaattcaataaatgtctctaagccccccatgaggttgaaagggcatagagataaatgagatatggtcccaaccctctagaagcacccattcagaagacagttttgatagcaaatctaccgtcagagccaagagcaacacacttgacctctttgtttgagttacaaaagggcaccccactttctggctgacaaagctccacaccagaacatagagaatactgcaggtagatcaagagctggattttgctgggccaagtggctcatgcctgtaatctcagcacttcgggaggccaaggttaacagattgcttgagcctaggagttcgagactagcctaagcaacgtagtgaaaccccatctctacaaaacatacaaaaattagccgggcatggtggcacatgcctgtagtcctagctactcaggaggctgaggtgggagtatccctttagcctgggaagtggaggctgtagtgggccgagatcatgccactgcactccagcctgggtgacagagcaagaccctgtctaaaaaaaaaaaaaaaaaaagaaaagctggatttcatctctgcctttataaaacagtccttttatgcagtgtgaaaactacacaacagtatgtggtatcttcagttctatagttggtacccaaattatgagcttgtggagatctattctttaaagacgtgcatgaaaatattagatgcatagaatttatggaaacatgaatccatatgttagaaaatatggggcagtgatggaatgttctactatttcattttaatcccagtatcaataaagggtaggaaaacagataagcctgtgggaaacaataaagtatttgagaggaaaaaaagaggagcaacaaacggaaaaccaaaaccagtgaagagggaatgactgaaggccctatggagaatgagcacttccttaatcttgaaactttaggaaaacgtaatatgtctattgtaagcaagtacatacagaaatgttcccaggaatgactttgggaggctgggccacatttgcgtattccagcaatgactatttcacctttgcttataaggctgcatttgtcatgagaccacagtattcttgaccactctataatattaccctcatcaacaaaaacaaaaatcgtttagggaattctttttttttgagacggagtctcgctgtgtcacccaggctggagtgcagtggcgcgatctcagctcactgcaatctccgcctcctgggttcaagcgattcttctgcctcagcctcccaggtagctgggactacaggcacgtgccaccacgcttggctaatttttagtagagatgtggtttcactatgttggccaggctggtctcgaactcctgacactgtgatctgcccacctcggcctcccaaagtgctgcgattacaggcgtgaggcatggcgcccggcctagggaattcttaagattagcaaaataatgagtctaactactaagcggtacacattaaaacttgaaaatattgtctttcttgccctcaaaatgaattacatttaagaagataatgtaggctgggcgtggtggctcacgcctgtaatcccagaattttgggagaccgaggcaggtggctcacttgaagtcaggagttcaagaccagcctggccaacatggcaaaaccccatctctactaaaaatacaaaaattagccaggcgtagtggcgggcgcctgtaatcccagctactcgggtggttgaggcagggagaattgcttgaacctgggaggcggaggttgcagtgagccgagatcgcaccagtgcactcccgcctgagcaacagagcgaaattccatctcaaaaaaaaaaaaaaaaaaaagagaagaagataatgtataatacagggtatagataacaagtgctataaatggtgctaaaattatggattttggaaatgcagggagaaatcaaattacctcttacaaccaggggaaagacagagaaaggctgtgctttcagctagctcttaaaggaaagggtaccacttcaaaaggcagagcaaggcagggtgaagaaaggaagtacattccaagtagagagaacactatgatgtaagtaaaggaggcagaattaagtgtaagtggtggatttagagaaaatcagtatatctgtttgacaaggatagtagaaataataaaagtgcctaactatggcagactgtgttctcccaaaatgaatgcagtgaacagcaatattttcagtttcacatgttatttattctatccgccatcaaatggtggggtctctttcccatctctttaatctgggttatgactggtttatgtctgtttcaactgagaaagtatagtggaagtgatgctatgtgacttccaagtctaggtcataaaggatatagcttctgcctggctctctcttaggacattcacctttggaactcagccaccatgtgtgagggagcccaggccacaaggagaggctacatgtaggtgttccagttgacagtcccagcgaaagtctcagccaacagccagaatcaaccaaaacacgtaagtacatgaacctgcagatgattcggccctcagactcaatgtcttccagctgaggcaccagataccaaagaaccgagacaagccattccctctgtgccctgtccaaattgccaatccacataatctgtgagcttaataactggttgtttcaggccaataattttgggggtaacttgtgacataaccataataactggaacactaatatcaattgggtaatgaccatatgccatgttctatgtttgatgccttatattttatatcagttagctatttctgtgtaacaaaccaccccaaatctcagtagcttacaaaacagttatttctctactatagctcacacatccgtgagtctattagaggttggctgacctaggctgggctcactctggtgtctaagtgttggcaggcagctctgctccaggccatgtgtggctggggcatctaagctaggacagatctgctttatgggtctctcatcctcctctaggaaccagcaggcttgcctgaatatgtcactttcatggggaagaatgacagtggaaacacataaagcttttgaggcctaggcttaaaaatggcacactatctggccaggtgtggtggctcacacctgtaatctcagcactttgggaggctgaggcaggtggatcaccagaggactggagtttgagaccagctgaccaacatggtgaaaccccatctctactaaaaatacaaaaaattagccaggcatggtggcacatgcctgaatcccagctacttgggaggcttaggtgggagaattgcttgaacccgggaggcggaggttgcaatgagttgagattgtgccactgcactccagtctgggcaaaaagagcaaaactccatctcaaaaaaaaaaaaggcgcactatcacttctcccacattctattggccaaatcaagttacatggccagacccagattaaagagttaggaaaacatacaccacctatttagtgtactatgaagtcacaaggaaagagtatgcactttgggaggggtaaagaattggagccagggccgagtgtggtggctcacgcttgtaatcccagcactttgggaggccgaggcaggtggatcacctgaggtcaggagttcaagaccagcctggccaacatggtgaaaccccatctctactaaaaaaatacaaaaaattagccgagcatggtggcagacacctgtaatcccagctactcgggaggctgaggtaggagaatcacttgaacccgggaggcagaagttgcagtgagctgagattgcgccactgcactccagcctgggcaacaaggcgagactccgtctcaaaaaaaaaaaaaaaaaaaaagaattggagccaggagtaatgtcagcaagatggctgactagagacacctgctgcttgtcccgcccaacaagaaaggcccaaggcaatgaataaacagctcactttgactggagtgtcgaagggagagcactggagtacagtgggggagtgggatgaatctgcagtgacagaagtccggaagagcagcatggaggcacccggcctctacagccccatctgcttttcccaaatcggattggcctgaagacaggagggacttcctgttgtggagaaaaggtaagcagatccccaccagccttcattatcttgacaaacacctatagtcctttctacaggagaaccccacagttctcacaagccctgagccccgtttgcagagctgcctggaattcatgcagctgcactgccttggattaggagtgtaaggtgtgcactccccacccccacccactccctgtgagcgaagctgctgcagaatagccccatcttgacagcagagccacctgtggagtgcaccctcctcccagggtcagcagccaccccagcactggggctccattttcattacgccaagcccacaagggtagctggatgccacagccctagctgtgcagagcttgggcccaggatcagctgtaactctggtcctgcaaagcagagaaaccaattcccaccaccatacatccagctagagaaagagtctgccggtctcgcccagggcaaactgtccatgagctagccaaaccactgtgtgtcctcccacatatgggagctgagatgccccaggccagcagagtggctacactagaactagccctgcagcacccctgcccccaacagtcatgctcctgacctgcccagtgggcctgtgtctccgataagagcttaagaaagagtcctgtaggtcactactggtggcacgtctccagggcagccaagcagccaagagcccatatgccggacttaaaaagcagtcccgcaggctgccccttgtgggcgtgcccctgagccagctgagcagccatgcacttgaatcccagacctgagaaacagccctgtgggctgcccctgacagtcatcccccaggacaactgaccggctgtgtgtccgtgtcctagattgaaaaacagccctgcaggctgcctgtagtggacacaaccacaagctgactaagcagtcctgtgctccttgcccaggcctacgaaataatctcatgggccaccacccacagaaatgcccctaggccatttgagcagcaatgcagatatgtcataggtctgagaaatagccttgtgcccaacccaggcagcagagcagtcatgcacccatgcactggatctgagaaataacttgcgggccacccccagcagacgtgcccctgggccagccaagcagacttgtgcccacatcctgggcgtgaaaagcagccccatgggccgccaatggcagacatgtccgcaggccaatcaaacagttgtgtaccagcatcctgagccagaggaacagccccctggaccatcctcagcagatgtgcactcacaccagccaagaagccatgtgatcacgtcttgagcctgagaaacctcagggaccacccccaacaaacatgccccaggccaactgagaaactgggcagctgtgtcctgggcctaagaaactctgtgaatcacccagagcagacacaccctagacccaagcagctttatgcctgcatcctaaaccaaagaaagcatgttgtgggtcacccctggcagacacatcaccaggccagccaagcagctgtgtgcccacatcctgggttgaagaaagtcccacaaaccgagatgcgccacggctttggtagcaacggcagctccagccgggcctgagctgtgctggcacctcccaggggaccgttggagttggccagcccctttctccatggtaaccatgtgcgaccgaaaggccgtgatcaaaaatgcggacatgtcggaggagatgcaacagaactcagtggagtgcgctcctcaggcgctggagaaatacaacatagagaagaacactgcggctcatatcaagaaggaatgtgacaagaagtacaatgccacctggcactgcatcctggggaggaacttcagtagttacgtgacacatgaaaccaaacacttcatctacttctacctgggccaagtggccattcttctgttcaaatctggttaaaagcatggactgtgccacacacccagtggtccatccaaaaacaaggactgcagcctaaattccaaataccagagactgaaattttcaaccttgctaagggaactcctcgatgtttgaacctttgttgtgttttgtacagggcattctctgtactagcttgttgtggttacaaaacaattagcacaatagcctacatctgtatttattttctattccatacttttgccccacgttgttttctctcaaaatccattcctttaaaaaataaatctgttgcagatgtgaaaagaaaaaaaaaaaagtcccacaaaccattcctggcaggcacaccccaaggccaactgagcaaccatgtgtgcatgcccccagccagagtaacaaccctgtgacctaaaccacagtgagccaaaccccaagttggctgacccactgtgtgcatacacacacacacaccaggcctgagaaacagtctgggaagcccaactccagcaaagccacatcattatcacaaattctctcagcctagaccactgagaaacacacaaatgccactagtatggattacagctgaagagactaaatggagagtacactactgtacatacctagaatcaaggtcaatgcaccccactgaactgacacccaaaggtttattggtacaaataagtgtttccctatgaagccttcttcataaaactggaaaacataacttttccaccagatgtgtagaaatcaatgtatgaacacatcaaccatgaaaaggggaaagaaacatgtcactttcaaggaaaacaatacttctctagtaacagactctaataaaacaatatgaaatgacagaaaaagaattcaaaataataatcttaaagaaccgcagtaagatgcaagagaatacagatagactaatgaaatcacaaaaatcagtttattatttgaatgagaaattcaacaaaaagatagatatcataaaaagaagcaaacagtctctccctccccctccccttccccctccccttccccctccccttccccctccccctccctctccctctcggcacggtctccctctgatacccatacgaggctggactgtgctgccgccatctcggctcactgcaacctccctgcctgattctcctgcctcagcctgcagagtgcctgggattgcaggcacgcaccgccacgcctgactggtttctttattttttggtggagacggggtttcgccgtgttggcctggctggtctccagctcctgactgcgagtgatctgccagcctcggcctcccgaggtgccgggattgcagacggagtctcgctcactcagtgctcaatgttgcccaggctggagtgcagtgtcgtgatctcagctcgctgcaacctccacctcccagccgcctgccttggcctcccaaagtgccagattgcagcctctgcccggccgccaccctgtctaggaagtgaggagcgtctctgcccggctgcccatcatctgggatgtgaggagcccctctgcccggctgtccggtctgggaagtgaggagcacctcttcccagccgtcatcccgtctaggaagtgaggagcgtctctgcccagccgcccatcgtctgggatgtggggagcgcctctgccccgccaccccgtctgggaggtgaggagcatctctgaccggccgccccgtctgagaagtgaggagcccctccgcccggcagccgccccgtctgggaagtgaggagcccctccgcctggcagccaccccgtccgggaggtggggggcagcccctgcccggccgccaccccgtctgggaggtggggggcgcctctgcctggccgccccgtctgggaagtgaggagcccctctgcccggctgccaccccgtctgggaggtgtacccaacagctcattgagaacgggccatgatgacgatggcagttttgtcgaatagaaaagagggaaatgtggggaaaagaaagagatcagattgttactgtgtctgtgtagaaagaagtagacataggagactccattttgttctgtactaagaaaaattcttctgccttgggatgctgttaatctataaccttacccccaatcccgtgctctctgaaacatgtgctgtgtccactaagagttaaatggattaagggcggtgcaagatgtgctttgttaaacagatgcttgaaggcagcatgctcgttaagagtcatcaccactccctaatctcaagtacccagggacacaaacactgcggaaggcgtcagggccctctgcctaggaaaaccagagacctttgttcacatgtttatctgctgaccttccctccactattgtcctatgaccctgccaaatccccctctctgagaaacacccaagaatgatcaataaatgctaagaaaaaaaaaattgataaacataatgactgcaaaagtctatcttttctttttagtattctttcttaaatgtattttctaccctaatatttcatgagaactttgattcctactaaaatatgaatgttcacataaaaaaaaagaagcaaacagaaacccaagagctgaagaattcagtgaatgaaatacaaaatatgcttaagagcttcagcaacagactagaccaagcagagaaaggaatttctaaacttgaagacaggtattttgaaataacatacacagaccataaaaaaaacggataaaggataaagaataaaaacgaatgaagaaagtatacagaatttgtgggtatcatgggcattccagaaggaaaagaagagaaaaggtgagcaaaacatagttgataaaataatcagcagaaacattcttgggagagagacagagatctaggttcaggaagatcaaagaaccccaaacagatcctctccaaggcacattaaaggaaaaacatcaagtcacatataaaggcatctcaattaaactaacaaagcatttctcagcgaaaccttacgggccagaagagaataggataatatattcaaagtactaaaagaaaaagaaactgccagtcaaaaatatacctagcatagctatccttctaaaataaaggagaagtaaaatctttgatagataagaaaaaaactaaggaaatttatcaccaccagaccagccttacaagagatactcaagggtatcttatatctggaagtgaaaacacaactaccaccattatttacctacatgcaggagaaagaaaggaatcaaagcttattgctacagaaaaccacccaactgcaaaaataaacaaaaagagagtaaggaacaaagaacatataaaacaaccagaaaacagggctgggagcactggttcacacctgtaatcccagcaatttgggaggtcaaggcgggcggatcacgaggtcaggagatcgagaccatactggctaacaatgaaaccccatctctactaaaaatacaaaaaattagccaaaattagctgggtgtagcagcgggcacctgtagtcccagctactcgggagactgaggcaggagattggcctgaacccgggaggcggagctttcagtgagccaagattgtgccactgcactccagcctgggcgacagagtgagactgtctcaaaaaacaaacaaaaaaacaaaaaacaaacaaaaaaaccagaaaacaatcaataaaatgacagaagtaagtcctcacctaccaataataactttgaatggaaatggattaaattccccatttaaaacatatagactggaggaattgattaaaacaattgataacaagacccaactttatgctgcttacaaaaaaactcacctcaccagtgaagacacacaaaaattgaaagtgaagggctagaaaaagacaccccatgtaactggaaatcaaaagtgagcaggagtagctatacttacattagataaaacatactccaagtcaaaagctgtaaaaagaaaaaaagaatgacattaattatatcttaataagggaaccagttctgtaagagaatataacaattgtaaatatatatgcacccaacagatatataaggcaaatattagatttaaagggagtgatagactccactatagataattggggactttaaaaccccactctcaacattagacagatcatctagacaggaaattattaaagaaacatccaatttaaactgtaccataggccaaatggacctaacagacatttacagaatacttcaccaacagctgtagaatatacattatttggggcatggtggctcacgcctgtaatcccagcactttgggaggctgaggcaggtggatcacttgaggtcaggagttcaagaccagcctgaccaacatggtaaaaccccaactctactaaaaaaatacaaaaattagccatgtgcagcggcacgtacctgtagtcccagctactttggaggctgaagcaggagaatcgcttgaactcaggaggtggaggctacagtgagccaagattttactactgcactctagcctgggcaacagagcaagattccatctttaaaaaaaaaaaaaaatatatatatatatatatatatgtatatatatatatatacgtatatatatatatatatgtatatatatatatatatacatatatatatacacattcttttcatctgcacatggaacattttccaggactgaccatatgttaggacataaaacaggtcttaaactttttttaattcttaaaaattgaaatcatatcaagtatcttatctggtcatgatggaataaaaccagacatcaatgacaagaggaacatttgaaactataaaaaagatatggaaattaaataacatactgctgaacaaccaatgggtgaaggaattaagaatgaaattttaaaattccttgaaacaaataaaaatagaaacacaacataccaaaacttatgggtcacaggaaaagcagtattaagaggcaaatttataacaataaatgcctacatcaaaaaagtagaaagatttcaaataaagagctgaaaaatgcacctcaaggaattagaatagcaagaaccaaacccaaaattcatagaatgaaataataaaaatagcagaaataaacaaaatggagactaaaaattcaacaaaaccaaaagctgtttttttaaagataaacaaaatcaacaaagcattagcgagaataactaagaaaaaagatagaagacctaaataaatataatcagaaaagaaaaaggagatgtcacaacgaatactacagaaatacaaagcatcatacagactacaatgaacaactgtataccaataaattcaaaaacctagaggttacagataaatttctagacacaaacaacctaaaaagattgaaccaagaagagatagaaaacctgaacatcctctataatagaagcatgtcaaaaaaaaaaaaaaagaaaaaaaagaaagaaaagaaaacctgagcagaccaataataagaaacaagatttaatcagtaataaaaagttttccaacaaaaagtagtctaggaccagatggtgttaacattctgaattctactgaacatctaaagaagaagtaatataatttcttctcaaactacctcaacaaattggccatagggaattcttcctaactcattctataaggccagcattaccctgataccaaaaccagacaagaacacacaataaaagaatacttcagtcaggccaataccccaatgagcatagacacagaaatcctcaacaaaataccagcaaaccaaatccaataacatatcaaaaagataatacaccatgatcaaatgggatttattctaggaatagaaggatggtttaacatatgcaaattaataaatgtcatacatcacagcaatagaatgaagaacaaaaccatatgatcatctgaatagctgcagaaaaagcttttgataaaattcaatatccctctatgatggaaaaatcttaataaattaggtatagaaggaaagtacctcaacgcaataaaggccatatatgacaaaactacagctaaggtctttatggaacagggaaaagctaaaagcttttctttaagaactgcaacaaggtaagatacccactctcaccagacttaatacggtactggaagtcttagccagagcaattaggcaagagacagaaataaagggcatccaaattagaaaggagaaattgaaaatgacatgatcttatatggagaagaaactaaagactctaccaaaactcttagaattaatcaattaatgaattcagtaaagttgcagaatacaaaattaatatcaaaaatcagtagtgtttctatacacaatgaactagctgagtaagaaagcaaaaccatttaaaatagctacaaaaaataaaatacctaggaataaatttcagtgaatggataaagaaaatgtggtatatatacacaataaaatactattcagtgattaaaaaaaaaatgaaaccctgtcatgtgcagcaacgtggatggaactggaggacaatatgttaagtgaaataagccaggaagggaaagttaaacaccacatgttctccctcatgtgtggaaactaaaaaaagtggatctcatagaggtaaaaagtagaacagaggatactagaggctgggaagggtaggaggaaggaagaggaagggagagatttgctcaaggatacaaaattacagctagataaaaggattaagtcctagtgtcctataccctgtaggatgactatagttaacaataatattgtatataggttgaaatagctagaagaaggatattgaaacacattcccaacacaaagaaataatacgtgtttggggccaggcgtggtgtcatgcctgtaatcccagcactttgggaggctgaggcaggcggatcacaaggtcaggagatcgagaccatcctggctaacacggtgaaaccccacctctactaaaaacacagaaaattagcctggcgtggtggcgggcgcctgtagtcccagctgcttgggagcctgaggcaggataatcgcttgaacccgggaggcagtaagctgagatcgtgccactgcactccagcctgggtgacagagcgagactctgtctccaaaaaaaaaagaaataatacatgtttgggatgtttaatatgttaatatgctaattatcctaatctgattaggctaatttgatatatacattatgtatatcaaaacttcactatgtaccccatgactatataaagttatttgtcaattaaaatttaaattaaaaaagaattggagccattactttatcacatatttaatcttcataattatcagttatcattattatatccatttcattcatttccttgataagtaaactgaggctttaaataatatgagtttacagagttcttagagcttttggtgaaactgtttttggagcttgccatggctgccttaccattgacagatcaacatctcagatatctttactcatccctgtatctgccagaccactactgactgcaagagtgatggggcatctagtctttttatcttaagccaatttccaaccctcctctgattgccccttaggatcactatatcaacatgtctcacatgtccatttgccttttgcaccagtagaggttcaaacacttctcaccattctacctcaattgatccattcatatggccccctctcccacttgttcctaattgcctgaaaacttcctgtgccctcagagactcatgatctcttaacaacatctataatattttctctgagctttcccttaatttcatgccctgactgaaagccaattgttccctaagggcactggttgccctgcagtactctgcaagggatgcgtttttgtttttgttttttcccactcttataccatgcacctctgggtttgaagatgagacgtaagaccagtatccttcttgattcctattgcagctttataagttgttctctttcctcttaaaaaatttaaatcctttgaagtttatgctatcagatgctacaaccccaaatattgctatactgctgacatttaagcctctccttattcactcaggattttagcacctggctctctttctttctattcatccctactcctgtcactgtgaaaggaaaataaacctttgggcccccaagtcactaaactaaagggaaaacccaagctgggaactgcttagggcaaatctgcctcccattctgttcaaagtcacccctctgctcactgagataaatacttacctgattgcctcctttggagaggctaatcagaaactcaaaataatgcaaccatttgtctcttacctacctatgacatggaaactccctccctgttgtcctgcctttccagatgaaccaatgttcattttacatcttatgttgattgatgtctcatgtctccctaaaatgtataaaaccaaactgctctgaccaccttggccacatgtcatcaggacctcttgaggctgtgtcatgggcacacatactcaacgttggcaaaatacactttctaaattaactgagacctgtctcagatagtcagggttcacatcgccaatcttgatatatgatcaaatcaacaatgaggcctcttagttccttgacctcctcaactctaattttttttaaatctcacatcagctgcccacttctacaggcataaatttgcccaataattatactctttgatccaagcacttcactctctgaccactatccctatctttcaagtgattttgtgtccgaaattggtgggttcttggtctcactgacttcaagaatgaagccacggaccctcacggtgagtgttacagttcttaaagatggtgtgtctggagtttgttcctgctgacatttggacacgttcagagtttcttccttctggtgggttcgtggtcttgctggcttcaggagtgaagctgcagaccttccaggtgagtgttacagctgttaaggcggtgcgtctgaagttctttgctcctcccgtctggagttgttcattcctcctggtgggttcatggtctcgctggcctcaggagtgaagctgcagaccttcccggtgagtgttacaactcataaaggcagtgtgcacccaaagagtgagcagcagcaagatttattgcaaagagcaaaacaacaaagcttccacagcatggaaggagacccaagcagcttgccactgctggctggggcagcctgctttcgttcccttatctgaccccacccacatcctgctgattggcccattttacagagagctgattggtccattgtacagagagctgattggtccattttacagagagctgattggtctgttttgacagggtgctgattggtgcgtttataatccctgagctagacacagagtgctgattggtgtatttaccatcctctacttagatataaaagttctccaagtccccctagattaactagacacagagcactgattggtacatttacaaaccttgagctagacacagggtgctgattggtgtgtttacaaaccttgagctagacacagagtgctgtttggtgcatttacaaaccttgagctagacacagagtgctgactggtgtatttaccatcctttagctagacataaaagttctccaagtccccaccagattagctagatacacagtgctgattggtgtatccacaaaccccaagctaaatacacagtgctgattggtgcatatacaatcctccagctagacataaaagttctggaacttcccacccaactcaggagcccagctggcttcccctagcggatcctgcgcctagtggatcctgcacctgggacgctggtggagctgcccgccagtcccgcaccaggcacccacactcctcagcccttgggtggtcaatgggaccgggtgccacagagcagggggtggcggggggctcaggccacgtgggagcccacagggggtggtgcatgggcatagcgggctgcaggtcccgagccctgccccatcaggaggtggctgaggcccggtgagaattcaagggcggcacgggctggccggcagtgctggggaaaccggcgcaccctccacagctgctggcccaggtgctaagcccctcactgcccggtgcccccagccggctgctctgagtgtggggcctgctgagcccgtgcccggccagaactggcactggcccatgagcaccatgcgcagccccggttcccgcctgcgcctctcccttcacatctccctgcaagcagagggagccggctccagcctcggctagtccagagaggggcccccacagcgcagtggcgggctgaagggctcctcgagcatggccagagtggacgctgaggccgaggaggcacggagagcgagggctgctagcacgttgtcacctctcaatttatctaatatctcacttcaaaattttatttcattacaacttccaattcactgagtctattattttttcattatctattgccctttcaaagacacacatctcattgaaccccttagattcaatggactatcatcatagtcactcactgagatcagggcaagtggtctcctctttatgaagatgactcaggagttgcacacatcacatttcgcaccctattggatcagctgggaagtggggcctttggggagttatttagataatgagggctctgcccttataaatggataaatgcctttataaaagacttgaagggggaaagttcactcttttccaaccctttcattccttccatcatgtgaagacatggcattcttcccttccagaagacgctatcttggaagctgagtccaggttctcaccagacactgaacctatcagctccttaatcttggactcccagccctcagtactgtgaaaagtaagtttctgttctttataagtcacccagtctcaggtatcttgttgtagcagcacaaatgaaataagacaactggctaaaactcagggcattctattattaaaagaaaagaggatgtgactatttggggacagttagtgatgtctgcacattacttaagcctaaacgcccacctagtctgtgctttcccacaagtaactaacagatcaaagtatgcagccatgatgattctcactccaaatctcaagtgagcaatcaattctacataacaaacttatacccgtatttaatacatttgatcttctgctctcaagaaatggctattttgggtgttctcctcttttctcaaacttctcacaatcccttagtatcttttacacctcactctcagctggtaactttctcttgtattctatagaaaaagtgaaagcaatcccagggagttacttttctttccccactaaatctactagctcattctaacattcttttctctcatttcaattctgactttctttgcccacatttttttctccttttacagtacacaaaagcaaaagatgttcctagcaaagatgaacacctctaaagcctatcttcagcctttctcaaggacagatgtctgtaataagcactttctcttgtactattatgttttgattttctgttggatttttccaacagttaggaaatagtctctaataaataccaccttcaaaaaattattagaagagaggactctgggaagatagcagagtagagagcacctgaaatctgtctccccaacttgacaacaattgcactgagggaatctgtcttacctattttgaaactctagtgtctgttgaaggcttgcagcttccagggaaggcttggatggtaaattgcagttaattctggtcaattttagcttagcacagtagcagctacccatcccccaccccccagccctttggcaagcagccatgcacacattccaggagcagctttcatatagcttgcagatgccagggtgagtaaaaaggaccctttcctccaaatatcagggatctggactttaatcactgattgctgtttctgattcacaaaggtgcagacagaggcaggtagccattgttgacctctcccaactgttgtatgcccctccccctccagctgaagcaacttccaggggattaaaagggctggcaccccctactccatttatttttctttttttcccccttttcagagccatatattaatgactaggatgttcaaaagtaacaggagttcgagatcagcctgaccaacatgatgatggagtgctgctgtgtacactaaactttatggcttggcaggtcaaataatgcccagttcatgaagggcagctcaggtcacacagtaattggtagcccatggtcaagcactcaggttctactaaggcccagtaacaggccaagagctgtctctcaaaagaagaatagttatctgcagaaaatggcagggtcctgatctaaaatcctaaagggctgcactgcagttcacctacaggagccttccaaagactccatcagcattcctgtctgccactgagacttcaggcaatactggatcggctggatcatatggccccagtggcaaagcagcttgcacagcagtatggatctcttgcagagccttttcctgttctgggccctactcaaaactagcagctttttgggtcacttggtaaatgggctagagtaacaaatccaaataaggaataggttgcacctaaaatctaaataggcccactagaggttacaattctttcttggctgtagggggggccaaaggcaacaacttatccttcactttggaagggctatctcagtatgcctcacacaactgaacccctagaaatttaattgagatagaaggcctctgaattttagtcaggtttatctcccattcttggacacacaactgttttacaagtctaagagtagttgccacttctcactcactaggtccaatcagtataatgttgttaaatcaagtttagcctaaaccttcttccttacatattttaacttcagcctaaaggtgtctgtgtacatcatgaactataacctaaatggagttgtatatagaccgtagcctactcttatatcagtcagcaagttttggccaatcaaatatggccaactgttcaaactgtgttcaaatacgggtaacactgagctgtaaccaattcatctgtttctgtacctcactttgattttctgtgcaccactttcctttgtccataaaccttctgctacaggggtgcactagggtctgagcctactctggctcatggcactgcccaattcacgaatcattctttactcaattaaactcttttaaatttaatttggctaaagttttccttttaacaatgtcattaatgtaaagggccagtgtgatattttgtggaaggaaacagtagacaagatctctgctaactaaattatgacatagggctagagacttgatgtatcactgaggtaacatgatgaaggtgtattgccgaccttgccaactgaaatcagactgcttctgatgggccttgtgtatagggatggagaaaaatgcatttgccatatcaatagctgcccaccaggtaccaggagatgtgtcaatttgctcaagccatgaaaccatatctacagcagctccaagtgaagtcaccatttggttaagcttataatccacttgttctctaaaatccatccatcttttgcataggccaaataggagagttgaatggagatgtgatgggaatcaccacccctgcatctttcaagtccttgatggtggcactaatctctacaacccttccaaggatgtggtattatgtttgatttacacttttccaagatagaagtagttttaatggcgtccacttggcttttatcaccattatagtccccactccacacacaggtcagggaaccaaagtaaggattatgccagttgttaagtatgtctacttccattgtgcattctggaactgaagaaaaaactgcaggataggtctgaggactcactggatgtactgtgctaaacctcctaaagctaaaactttaggacctgagctaaaaatccattgatcacttgacctccatatattcctattgtgactggagggccacagtgatgtttggggtctcctggagtcactgtcagttcagagccagtgtccagtagtcccttaaagttctgattcctccacccgctccctgccccccacccacccccctgccggaaacccatgcacggttactctggtaaaattgtgtaagtccctttggagaaggctgggctaagcattaacagtatcaattttcagtagtgcaccagggtcttctcttgatgggacctgactgctctttgtccaaagggctctgggtctataaactggctaaactctgggaattgaatgggggtttatgactctctgttttataattcaacttagacttttttttcacttaacctggaacttttctgctcatacagaccaagtaagaatttagtaggcttcctatctatttcacatctaggaacaccatggataactagctaacaccataggtccctgtgtgtcagactacggtgattgctgctttgactctgctgggcattacaataactacatccactttgcctttgttacctgagtgctgacccttggcccctgtcaccctgagatccaattactctcactctgtttacattttccaactgaatggctgtggttccctctgtaaggtctatcctatagagaagagtaatcatggagctcttccaggatgctagggctccccttatgaatttatttctcaaagtattggtgaaaagtatgtcttctggacccacccagtgtggtaaataggtcttaaatgacaaatccactctaacattttaatctccctaaccctttgaatccattcctctatattaaattaagagacatcagtcatctccaactcactcttggtgggccactttttgacccatgtttcagcaaccaaccaaactgttagagccctttctaactctctgatttagaaataatgtaatatttctgtaatattaaatgcagaatctcaacttagtgagcccatatctatacattcagcctgattcaactttgtttcttctactattctcctacactcttaatattcattcccatatatgttccccagatttctccttatataaatcagaaaactcaagtagttcttttggaatgtagtgcaccttctcatgggtcacactttttaactcaaagtaggcccttcagggatggcaggggtagattagatcctgagaagaaccagcactgtcttgcatagcaactgcctcagaggaagccattactgcttcctcagggttaaatacctcagactgaggtagaaatacggaaaccactgtgggtgggaaggctgctaccaccagaggtggggagacctatgccatttagggtggggaggccactttcactgggattgggaaggttacttttgctggggatggagaaacctcttccactggcaaagaagatgcatcagaatttagggtctcaatgtctgtagcttcatcaggctcttcctacatatccccatcccatcttacaggatcccactttttctcaaccaatgccatcactttaacagtagatatcacgtgaggctgggagttcaacttgctttgtaattcagccaattgcacaatgagatcctgggtttgattttcagcaattttagccctgtggctacaggagttaatgatttcttagggcacaactacaagtttttaagtcatttatacagtgagtgagctggaaatttgaatcctgagcccctccttttcttttaccacttggtcctacattagaagcaacaaaccaatgtcattatattccttattttccattgtccaaaaatgttcaaaagtatcatatacagagttacttagctctttgcttcttattagttaggagtatccaatgcagatattttatatatctctagaaacagttcactccctggactatcagtactttctgttcctctagaaccactctcagtaccaaaatattttattggtcagagttctccagggaaagagaaccactggagattacacacacaaacacacacacacacatgcacacatacacacacccacacacacattgggaattggctcacatgatgatggaggccaagaagtcccatgatctgccttttacatccagagaaccagaaaagccaatagtgtatagtagtccccacttacctatgggttttccaagacccccagtggctgcctgaaactacagagtaccaaaccctatatacgctattttttcctgtatatacatattataaagcttaatttataaattaggcacagcaagagattaaccacaataacataaaacagaacaatgataacaatataccataataaaagttatgtgctgtctcttacttgctctaacgttctcaaattatcatagcgtactatacactcacctatcttcttcatgttatgatgtgagattataaaatttctgatgaaatttccagaaataattcatacattttaaattacacactgttctgaatatcatgaatgacacggacattgtgatataaatgaaattaccagaaataagcaattcgtaagttttaaattacatgctgttctgaatatcatgataaactctcacactgtcctgctctgtccaacccaattacaattagtcacttagccgtacaggttatcagatcaactggcccagtatcacaatacttgtatttaagtaatccttattttacttaataatggctccaaagcgcaagagtgatgatgtaatatttttggacctctgttgactgcagatagctgaaacttcagaaagcaaaaccatgtataaggggggactactgaaatttagtccatatgtaaaggcctgagaacaagaagagctgatgtccaagaatagaaaaagatggctgtttcagctcaaacagagagaatgaattcactctttcaatgtgtggttctattcatgccctcagcagactggatgatgcctgcctacactggtgagggcaatcttctttactcagtctactgatttaattgctaatattatccagtaacaccctcacagacacacccagaagtaatgttttcaccagctatctaggcatcccttagctcagtcaagttaatacataacattaactatcacataaggattctacccagtgttagggaaagcatggacctactgacaccttggtttttttgtttttgtttttgttttttgagacggagtctcactctgtcgcccaggctggagtgcagtggcgtgatcttggctcactgtaacctccacctcctgggttcatgccattctcctgcctcagcctcccgagtagctgggactacaggcatgtgccaccacgcctggctattttttttgtatttttttttaatagagacagggtttcactgtgctagccaggatggtctcgatctcctgacctcgtgatccgcctgcctcagcctcccaaagtgctgggattacaggcatgagccaccgcgcccccccgcccgacaccttggttttaaactgctagcttccaaaactgtcagacaataaattcttgtttttttgtttgtttttgttgttttttgtttgtttgttttttgagacagaatctcactctgtcgcccaggctggagtgcagtggtgcatctcggctcactgcaagctctgcctcccgggttcacgccattctcctgcctcagcctcccgagcagctgggactacaggcctctgccaccacggccagctatttttttgtattttcagtacagacggggtttcaccgtattagccaggatggtctcgatctcctgacctcgtgatccacttgcctcgacctcccaaagtgctgggattacaggtgttagccaccgtgcccggccaaattcttgttgttttaagctacctagtttgtggcactttgatacaacagccctgggaaacaaatacaccttacttgttatccacatgaaaagatattctagagtcactttgtcttattttgggcaataattggtaatttcatttggtttaaacatttttttaatcccagtcctagagtcagtaatatctctgaagagccattattccttggaaaatagtatttcaagataatgatctgggagcaagaggtgctcccaaattctggagcactggactggtcatggtttgttttagcttttatggggacaaatatattttataagatgaaacattgagtttgggttttttttgttgttaagaaaagacatttcctgctcttgacttggaatcagaatcagacatttctccacagagcactggtcttgaaatcttataatttaggtaccaaatatactcattactactgtgttggtaattgtttctaggcctcttcagagccagcagggaattttgacaaaattcaccatgatacttctaattcaaattcaggactacagaatttgtacttatcctcctgtaccttacatctgcatcgtctttctcccatatgataagagattagcattgtgaatgagtaaataagattgccctcaataatgcaggtaggccttatccaatctattgagagcctggttctcaagaacaattgggattagataattagaacataatataattactcgtattctttaatccacatttcacataaaattatcaaaatacatttccaaacattatcaccaacaatacaaatgcaaacacttaaatgtttttggacatttctttttctccttaaaaatatcccactatggatatctagtcaaattattgtgtttgaaagtcacttgaaaaagttctttgtgtgttatgtaatatccggttaggttaagtaacttaatttttagtttggggaattgcttttcaaaagttgatttttaaaaaactaagtaaaatgtgtgttttcagtcaaatctaaaaaacaaagtacatttaaataacgcttttttttctgtcttctccatactcttctctcccagtccttataggtaacctttaaagatacatacatatggtttatatttcctttttttttttttgagagggagtcatgctctgtcacccaggctggagtgcagtggtgtgatctcagatcactgtaacttccacctccctggttcaaatgattctcctgcctcagcctcccgagtagctgggatttcagatgcccgccattgtgcccagttaatttttgtatttttagtagagacagggttttgccatgttgaccaggctggtcttgaacttctgacctcaggtgatctgccctcctcagcctcccaaagttctaggattacaggtgtgagccaccgtgtctggccatatttcctttaaaaaaaaaatagtaagcaagtatattacacacatttttgtattttctcttttcttaaatggaggcaaagaatacttttccacatcttgcttttttcattcagcattatattccaaagatcaatccatagtgggcatatatatatatatatatatatatatattccttatttcttcttccagctgcatagtcctcacctgtgtgcatgtactatagtttattcaaccaacctccttatatggacatgtgggacatggacgtattatataatcttcttatataaaatatttactttttatataaagtaaatatagtttatatggtaggatgggtgttaatgcagtcctacaacaaatagtctgaggcatacatcttttcttatttttgctacagtatctgtgggacagagtcctagatttggcattgctaggtcaatgggcaaattcatacataacttttactacatatagttgggcacatgtgtaactaagcaatctgatatatttaatcaataaatcagctttcagcttaaggaatcatctcattatattaacatacaaaaattatgctgtgggctgggcgcggtggctcacacctgtaatcccagcactttgggaggccaaggcgggtggatcacaaggtcaggagttcaagaccagcctggccaagatggtgaaaccctgtctctaccaaaaatacaaaaattagcagggcacggtggcaggcgcctgtaatcccagctacttgggaggctgacgcaggagaactgcttgaacctgttggggcagaggtttcagtgagccaagatcgagccactgcactctagcctaggaaacagagtgagactcaatctccaaaaaaaaaaaaaaaaaaaaaaaatatatatatatatatatatgctccgtacttataaccagctcaagtctgactgctcattgctcagaggctgaaagcatgagaagcgacgtgtagtgaaaggaaagcaactttattccaatgttagcagttgggggatggacaggctcatgcctttaacagatcactccaactttttggagtgagtgaaggggtttaagaagcaaaaaggtgtgggaaatatgcaggagtagcgcaggaaggtgtaggtctgtgtgtcttcttctgacggtcatcttcagtaactgcctgcctgaaggcccagttcatgtcatcctgacctcagctggtagtgctgggctaatggttcctaatcccccttgagcaggaggattctgcagttggggtctctctgtctagtttgtttcaaaattggcccctggaatttttaagcaagcacatcattaagataagtgagccctgttctcagaaaaggctggtgggaaagggacaaacagtttcaaagtatgtttcaaggctgaaggcaagcaagaaagaaaaaacaagttttaaaatgcattgtgaggctgggatgctgttagatattcaccacttgagttatcaaaatttggctgagtttcttgtaaagtaagcattggccactgacatcattatttaaaaaaaaattttttttttgagacagggtctcgctctgtcacccaggctggagtacagtggtgcaatcttggctcactgcagcctctgggttcaagtgattctcgtgcctcagcctcctgagtagttgggattacaagtaggcaccagcatacccagctaatttttgtatttttagtagagatgggttttcaccatgctggccaggctggtctcaaacttctgacctcaagtgatccacccacctcagcctcccaaagtgctgggattacagacctgagccaccactcccagctgttgttgtttttttgagacagagtgtgtctccagctctggtgcccaggcacgatcttggctcactgcaacctttgcctctcatgcctcagcctcccaagtagctgggattacaggcacatgccaccatacctggctaatttttagcagttttagtagacacagggtttcgccatgttggccaggctggtcttgaactcctggcctcaagtgatctgcctgtctcagcctcccaaagtgctaggattacaggcatgaaccacaacatgcagccatcatgattaaaatgtaatggtagtgttctacaaagtgatttaagaacatctttccccagctttgatgatattggtgtagctgttacagttaccattaataataaaacacccaccaaatacttgtcaaagcacttcctactacctttgattttccaacaacgataggtggtggtgattatttcaccttattgacacagaatcatggcacaatgtcacacaggaatttagtggcaagagtcaaacctgattccaccaaaactccacactaagttaatttacttttgctaaaaactacaaactggtctacactttgttctacagaaaataacttagagctggttggtgttttaagacatgaagtagcaatttcaaactaagttacaacagacaaagataatttaaaaagattttaaaaaatctcttcatcacatgtatagaactaatttgtatggtcagcaatttcttatagccaccatcaaaaatttgtgcatgtgaaaatcggcagtttctttgaaaatgacaaaaacataggtgaaatctgaatgcagtataattttttttggtaggactgaaatatgtatgctttcaacagcttaaatgaatgctatgactatgcactacactttaaaacagggactttcattaagattggtaaacttgcttggcacggcggcttacgcctgtaatcccagcactttgggaggccgaggcaggtggatcatctgaggtcaggagtttgaaaccagcctggccaacaatggtgaaaccccgtctctaccaaaattacaaaaattagctgggcgtggtggtgtgagtctgtaatcccagctacttggaaagctgaggcaggagaatagcttgaacccacgaggcagaggctgcggtaagccgagatcgcaccactgcatgccagtctggatgacagagcaagagtctgtctcaaaaaaaaaaaaaaaaaaaaagaaggaaagaaaaaaaatgattagtaagctcaaggcatctttcttcttcaattctgtatcctcccaaagtgcccaatacatactgagcatacatacatacatacatacaaagtgcccaatacacactgagcatacatacatacaaagtgcccaatacatactgagcatacatacatacatacatacaaagtgcccaatacatactgagcactagggcctaaatatgcctcaaaactagttttgttttttttctttcttcactatttaagaaaatggagtttgctgggaagtcacaagattttagtttaagccaatttccacaatctttttagactcttctctttcttggcattgttgctaaaatagtcatttggacagtaaaatatttaaatgtttggacacagaaggtttgctgtcattttgttgatggtgtagcaaaatttatacatcgattttttttcccttttcttctcttgttttacagttatctagtgtttaggctgcatattaaaagaaagacgcaacattttaactcccagtataaatcattttgaagttaaaaaaaacacataaacattcatcacaaggagagtactattatgtatctatctaagtacatagctgctacaaagtgtaagatcacaaacagcaaatcctgtataaatgttttatatagtagaaagagctgttaaagttagaaacgtcattcaagctgtaggagaccaagaataaaaagttcagatagaaacaatttaaatatgatgctaaatgtaatcttacttgggagaagttttctctcacaaattttgttttgtgaattaaagggctgcagcttccaagtattcagtcctacaattttggtataacagaaaatatttctttccgaaactaaactggatggcacacatatgttgcaatgaaggcatataacagctattgagggactggaaaaccaatatattggaatggaatccatgatggctagatgccagacacacaagcaatctaagttcctgggtaaatattaaccaagtgcttaggtcttgttgcaatctaggtgtaaagagagaagccaactcagagcctccagggagtctgatggtcttaaggaggccaagactaggttttctgccattttaatccagtaactacaatccattatttcacagattaattctgtgaagagcaaacctcgtagcttttcttccctgtcctgtctgcagtggttttaactttaattgatggcgaaactactcaaccttttagtcaagaatatcaatagtaggggggaaaactaggtggaaggtgagggattccatgtgcaaagcgtttgggagtatgtaatagggaggtaacaagaagtcctctcaatatgtagtaaaacttaacaggaatggtattgtttagtgtaaattttcgggctgtcacctgaatattaaatgaattacaaatgttgatagaatcataactttatataatataccaagaacactgatttcctgtgatttttttctttaagtgtcccagaccatgcagctgtgcaggaaactgggaagcaactgttaacaggggaatggacttggcgtgaaaagaaatgtcaaggttcatagatatcctctacacccattcacaatctcccattttctgagtattcaaggcctctggtttctctaatccctttcttcaagtcttggcaagatgcattttttttcctctttggtaagacgcctttgatattcttcaaatctggtttcaccagcacagaactttgacgtttcgttttgctttgtctctggaagacaaactccctcactcatccacgcgacatttcaagtccctcaaaattcccagggacaagaaaactaggtactatgaattctgccttccaaacagcattctctgttctgcttgcaaggtcgatataaaggcaggatttgcttgggcagaacaagtcaaaagcttattgaattgcacttattgaattgaacatggaacacagccggcttgctctcttatagcgagaggccatgcgagttggtgggtcaagggcatgcatttcaaagtgatcagtcactatacgttggccacatggagtcgcagtattttggcaatatttttaaaaaccagggaaagttactgtgctgttacaatccaaaggctggtggggttttcttccaccccgcatttccactagcgtgataaattatttaaagtacgtggcctagtagaggactaacctctgggtaacataagcctagtcttcgcagcgtacccactgtggaaacaaacgaatcagacgttactaattgtggaatgttaaaagtaggccccgatcggcttttactccctttggaaaatcctacacaattctgcgcgcgaaagacccaccctcggtgaggcggtgaggcgcgaacgccgcgaagctcacagtcaaagcctcgctgacaaatcaagagatgactccgcatttaaaaccttcccgaataggaacgcgccagaggccggaagccacgccacgtgaccagtcctcctccgcggccattcctagcgaggcagtaggcaccgcctctgtcacatttcctagctcctaaagcgcgggaccaggcggaaacgtgcgacaggaggcggtcccacctagctttggactggagtgtcagtagaactcccgtcttttccagcaacgctttgcaagttcttcaccgcaaagaactgccgcagacttccgcctgggtgccaaccacgtgatcacgcgagcgttggagaggcgtaggtccgatttcactacttcactccccgggctccgccagtccagtacccgccacggcgcgtgacaacgcggctcgccggcggcctccgccccggcgcgcctgcgcacgcggctctcgcggtgtctcgcgctcagccccgcccacctctgcccccgccctttccgcccctccctcccccttcaccctgtctctcggcggcggcggcggcggcggtggtggctcgcgcagcttgttggctcgctatataaaggagagaagcgggcggaccggacggctggagctgcagccggtggcggcagcggcggcgcagggagcggtgaccggtggtggtttccctccttggcgcggggtggggagcgggcaacgccccccggacccctgaagggtcgtggctttttttttttttttaaggcgattctcgaggttttcagctgcgggaggagtgcccccctcctcctcctctctccgctctcccctactccttcaggattgattttgtttaaaattttttccccaatcttgcggtgatttgggtcaccctccgggtgttatagtttttttttttttggttttgtttttatcttgttttcttggggttgccccctcttgtttgtgttgtgtgtggaaatggcgaactcggcaaatacaaacaccgtggtaaggacgtggttcggtggccggcgggggcttcgttcaggctgcagcaacggccggaccgggcgggggcggggacggcggcgactcccggcctcgactcttcagccgcccgcgcggccgccgccgccgccgcttcccgcctcgggcggatcgggccggagcgccgggcggcgggcgcgggggggcgccgagggctcgcggcgcggggagggcgggggcgccggtggggcctggggccgccgcgggccgggccgggccgcggaggcggttgggcccggtcgggcgcgcagccccggccccagaacccggccgccgggagggagggcgggaggggagccgccgcttccccccgaggggcccgtccgcgctggcttgacgagggctccccgagtggctacagaacaaaaactgtgtgtggggaatcgggcgaacccccgagacccatcgtgatccactttaatgcagtggaagattaatggttactttgggggtttcttaggttgtttttggcggctgtgctttgggaaccttctctgaggccattttatgtttaaaaaaaggacgaaggttggttgaaaagcacttatctcagttccttccgaatgggtaaaatggcgaaggggaagacccccatcgtatcttcgcctagcagaagcaccaaaacaaacaaaaaaagcctgcagtggtccaagtgtccccgctttcgccttgaaatttacctacttcttcccgttggtccctttttgttacttgcgatcacgtaggtttgcaaaaagcagtcacataaataaccttttcagtcaccaacgcagtgtgatcactagtccacccaactcttatttttatgatgacaataaaacacgttttttgcccggtcccaaatgccgcagaccagcccgcggccgcccgacaccgtaccgttggcgactcgggtctaaccatcatggctgcggccgcttaccctgcttttcagtccctgagccttgtggtcctcctccctttggctgccctgtttatatagagccattgccgctctctaatatagactctgccaggatgggaaggtgcttttcaggcctacgtcaccgcctctccatttaaacaccagatccggctttaaatagtgagagctgctgagagcggggctgggaggtgcgtgctcccgaggcaagagccaggcgtgtgcagagctcagtttatttctaggtccttttttcaccctgtgatttcgcacccgtcgcgggctgctttcagagccccaagttttggttttgttcccagcagcagctaggatttgccttctttgtttgctagggggaatatatccgaatcgctgtccctttttgtttacaattttcaaaattaattatttaaaacaaagagttttagatcagatggtctagccatttttcttatgtgcattattttcgggaatttaaaaaactgctttctacatggaaaatgttagctgcagaggacttggttttggtagtgttttgttcaagtattcaggaaataatgttagaaatatagctcctaatatttcattatgttttcctatagtaaatataaaagacacgaggcttttcagagaaatagataagtacctaaagcttcagtataggaccatttatgtgtaggagaatcgtgagtagagggaagagacagactgcaaactagattaaaaaaaaatctaagtagaactttattgccttggatattaacatgggtatccggtataaaaattattccaatttattttccagcattgcatcagggaattaacatttttgaaggaaacctaacaaatgacttaataatgccactagtggccctctgatttaccagttcttaagtttgaaataacctgttttttaaaaattaggacaaacttaaattgtatttcgtgaaagaaactttgcctcaagtattagtgtagaattttaagcaataatttagaaattgcttatttcaaatactcctatgtgcccacatacttttcaaaaattagtatcttgaaggcttttcaaattgtgaacaattctgctaaattactcgttaggcatatattttgtgaagaatacacatttcccttccttcacctatagggcttatgaagctgttaagtggtcaagttgtgagttcattaaggcacaaaaataaaatcttaatgatttattaagttgagagtactagaagaaagcagatttatacctacacatgtctggatctccaagcaaaaggtttttagaggtaactgacttcagaaacgccaaaacaccatctagtttactgaaaagcatacatattgtcaatttgagatttatactcccaatttaaaatacattgccctcctaacgcctcgaggagtaattattggttaaaaaaaaaaaagcactttatagagatacttttgtaattcagttaagtcactttaggcaagatgatgtccatagtcagatatactttccttatatatagaattagaatgttaaagtagggactatagaaatgtgcattttacagatgaataaacttcaagaggcggatttggcaaaataaagcaggttagtgagtgaacagtaaagcaagaacccagatatttgaattggttttcttgtaatgagaaggattaaatagtatttaatggttgaggtaaattgtattgacaaactcatttgtatttgtttgttttctgagacagggtctgggcctgtcacccaggctggagggcagtggtgcaatcttggctcactgcaccctctccctcctgggctcaagccatcctcccacctcagcctcccaagcagctgggactacaggcacgtgccaccactcctggctaattttttgtggagattgggtttcactatgttacccaggctggtcttgaactcttgagctcaagcgatcctcccaaaattggttttatttgatagcgattaaccttaagcaaggtatgaaacagaagtaatgagaaaacatctaaaaagcttgttaaccataaccctctgataatggggaggatttataaccaggcaactctagttttgtcaaggcagctctagttttgtcatctgacatgacttccttttgtctaacaggttaaaaataggatgtgggggaaaaaataggatgtggattgggctaattgttctatctcccactttgtagtttttaaaaaatattttatactttttgaaagttctttcacatctattctcattttactcattttaccattcaaccttctagaagccagcttctttacttcccgctcctccaagtagtatcaacggtgctaattgtaataataatagtaaacatttagagggttcatgttcattataatgtttcatagcattacctgggcagtagtagaggagaaatcctgggaaggaaatcagtataccttgttccttgggaccttaagacctgccattgtgagtgtatgagtagtttaatggtacagcttgaaagtacagactgggtcacacaacagaagttaggtgatttttaaacctgaatgttcattaggttgcagattattaccaggcagatgactcccggacataagattctccaaagtctaagatacagtggtgaggtagtaagacatacaacagagttcaaaccaagcatggaatagtagaagccagacataagcaacccgtaaagctattattgaacattacattaggtattttgactacaacataggaaattataattggaaattgtatggaccttgtagtcttaggggccttctgtttatgaactgcattaatcttaaaatttttattaaagtgtgcagtcatcaaatccagtttatggcaaatgatggtggtcgtatctttaaagtcatatatagatagttggcaaaatgactattcgttttgaatttgtgaaaacctgttatacattataagctgtgaaaaactgtctttttcaagtcttttatttttcctttaaagcctaaattatacagatctgtgattgaagatgtcattaatgatgtgagagacatctttctggatgatggagtggatgaacaagtactgatggaactaaaaactgtgagtttgtcttttttttaaaatattcctacttttcccccacaaaacattttctttagccggagatgaatctgtaatttttctataggatgaacgtatagttgagtgaagtgtgctggttttaaatcccaactctgccatgcattcttcctctgaccttaggcaagctacatttatatttcagttttcttatacgtaagatggaaattggtagtacttaccttataggtttgttttgaggattaaatggaataaccatataaaatcttagcacaatgcttgatagtagcattagcagttattattggatagttaacattctacattttatggtctaattacttgacatgtctggaagaattttgttgctttcttttttcgttttttatttttgagacagggtcgggctctgtcgcccaggctggagtgcagtggcacaatctggacttactgcaacctctgcctcccagactcaaaccatcctcccacccctgggactacaggcacatgccagcatgcctggctaatttttgtatttttggtagagatggttttcaccatgttgtcaaggctgctttcgaactcctggctgcaagtgatcctcccgcctcggcctcccaaagtgataggattatgggtgtgagccacagcgcccagccttaatcttatctttttttaatggtcttaatgtacctgtattctaaagtgtgttttaagttgtagggattaagtgcttgataaaagaattttaggttcttgaagtagaccctttatgtaggccgaatgttttgaatatattttacattgagagctggttttctgtatcttggattcaagtggaaatatttagattttttttattagcagttgtgttttccttgcattgtaatgactcatgaaattgtggaatatttttgccctgttgattagaatagtggttctcaaggtatagttcatggagccctggattctccccaagggttctttcagggggtccacaaggttgactaaatgcttaagtctggaaaatcatagtttgcccgtcattctttcaagtaaaagttgtattctgtgagaaaagtgaccagttaaattcacaattcaagtgcacaggtgcttttccttgagataactgtaaataagcagcagaaatgctttatgtatacttctcatttctgacaaactgaatattaaaaagatgaggactcaatgttgatattaagaaatttgattgtttgatattccgtaatgaagtgtgtttacagttgaaagatccatataattcactgaacttgtattttctgaatatccaatgcataatgttggaaaattcattcaaaatgcaagataaattaatggactttaaaagtatgaaaagttcacagttatatggtttcatattctgcattgtaactaactattaagaaactgtcacttaaaagtaccttttcttttcccaactacttaattgtaggaaggcagattttctttgtacacctccaccaaaacaaagcaaaaacagggtcagatacgagaatctagctattttcctttaagtcatttgtcattctcactcaattttatttactaaaatatggctattttcagaaaaatgttatttatgttaacatataatggatccattatttctaaacaaattagtgaaaattaaaaatttgttataatttctattagtataaatataggtggatgtaattcacatacagaaaagctctttgagggtctcagtaatttttttttttttttgagacggagtttcgctctgtcacccaggctggagtgcagtggtgctatcttggctcactgcaagctttgcctccctggttcatgccattctcctgcctcagcctcccaagtagctgggactacaggcgcccgccacgacgcctggctaatttttttgtatttttagtagagatggggtttcaccgtgttagccaggatggtctcgatctcctgaccttgtgatccccccacctcggcctcccaaagtgctgggattacagacatgagccaccgctcccggccgggtctcagtaatttgataaatcgtcctgagatgaaagagttttagaactgctggtttagaagttgattattaggctcctttaaatctatgtacaaataaataatcacagttaataaatgttaaggaacatttgttgtggtctcatccattcagcataggtgtcgaggctgcaacttggcaaccagttgcaaatcttaccttgattgcggtgatgaggtaggtcttggcgtatttattaataggtatctacaggaaacttctctagaattttcaataagaatattcctgtgtgaggagtttgagaccagcctggccaacatggtgaaaccctatgtctactaaaaatacaaaaattagctgggcatggtggtgcgtgcctgtaatcccagctactggggaggctgaggcaggagaatggcttgaacccaggaggcgggggttgcagtgagccgagatcatgccactacactgcagcctgggtgacagatcaagactctgtctcaaaaaaaaaaaaaacagaaaaacccaaaaatatttcctgtgtgaggtaggaaaaatatataggtgtgaaacagatgagcaaatatttatttaccttgagaaaaattacaggttactaatagtgaagagtaggtatctaaaaatacaagtgtaagagtgctaattccgagacatgagttggaagaagaacaatataaattgttcaagtagcatgaagtaactgagggatgtgaataataagaaaacaagcttcttttgattccttagtgtaacgtggaatgagttttttgcaatttatgttatacttttataatggttgtccttgtagttttgtgaccttgtatagaagatgcagcatttttaggtgtagaaaatcagttctaaagatgttaggtaattttctctaggtcaaactagtggtcagtctagattgttatctactctcgcttttcacaatgaaaatctggagaattttccctatcgttaatagtagaatcaagacattctctcgaagagaatgagcatctttgagaccaaatgtttccacctccatttttgttatatatgacttttttagtacatattttataggtaacacactgatttttagtttaatggttagtttttaaatgacaaaaaatgtgacctactcaattttgaatccccagcttctaccacgatgtctgggcatatgtggttggcattcagtaagtatttgattgaagtgtttgataatagatacggcacctgaatctaactgaacaaaatagtgtaatattcttgttgtttttaaatgggccatactcttctatctgggttgtattggagttaaaaataaaacggttagactaaaatgagtttgttattttaattctctgcactgaatttcttcaggatctcattagaatttctagaatatgccctagatttaacagctggacagccagcattgtccaatagaactttctgcagtgatgaaagtgttctgtacctgtgctcttcagtatggtagccactagccacatgtgcttattaagcactcaaaatgtggttggtggaactgaggaactgaatttttattaatctaaacttaaatcactacatatggctagttgctgccatattggactgctcaggtttagacattcttgcttaataaaacgaactttaatttcatattttatggtttagaaagcctgtcattagctctagcccctctccctactttctggggccattttacaaacttatcaaaagcttgtataaggctgtaaaggaggcagtggtgaattagattgagaacaaagatgaatgatgagaatgcatgtaatttgagggttaatgaggtaagcagaaagggagatgataagaatatttcaacccaatctttgaggttatcttttgaaacactgcaggcctactttaatgtgtaaactgtgagaggtagaaaaaacacaataaaatacagccctggttttcagtaaatctatattcgaatgtaaatgtgttttggattggtgagtgtctgtgggtgggaatgacactgtagaaattctcttcaaagtgaatgataaaatcaacctgatttctagattttccaacctacctatgtccaaatgtcaagtactgtgggagatataaaacattttctctctttttaataaaacaaatgagaagagttgcctcaattggaagtatatctgaaattcagtttatctgcctctggttcagatttctcaacactggcattattgacattttgcactggttaattctttgttgcaggggctgtcctattgattgtagaatgttagcagcacaactggcctctgcccactagatgccagtagcactcttcagttgtaaccaaaaatgtctctagacattgccagatgtcgccgggggccaaaatcacctctggctgagaaccactattctaaatatactctagttatatatatatatatatatatatatatatatataaagtacttgatacactctaattatgtgtaaatatttggaccataagttgaataataatctactatttcatttcatttattcttagggaaagctctgtttctacagcattatttcttgggaacctagaagtgtaatatattttatccaggagctagatgttttgtgaaagtaggagaatccttcagaatttctagcccaccatgttgccaggtttagccacctaacctctgggcttgtgatgtgacgggctgcagtgaaggtctctgatgtggcctggagacattttctccatggtcttggggattaacagtaggggagtgataaggggattaacttggggagcagtaggtctcatcacattttataggtgagaaagtagacttggaatgtgctttgacaaggtcgtttagctaataaatggtagagccatgaacctagcccttttgcctctatgtgacatatacagtacttagcagtaagcaggaaggtaacagagttttgactagatcttgggttgttggtgaatggcacctgagatggttttgatggtcggtgacctgctctgatagcagcagtctagtttagagactaggaatttggactagtactgggattaaagggaggcaagtgagggtcctggggtacagaatgcagagacattcactctctagccctgactgggacattgaagtcagaccacctgggttatatccctattctgtctgccattagagtgatcttgaataagctacctaacttctttcttgtcagattctttttctgtaaaagggagataataatgtctatcttataggatttttgtgaaaaaactagtttgtacatgtatttataaagtacacagaatttagtaagttttagttattagtcaacacaatatacaaatgtatacctgaatcattttgggaacagaagatgaattttctccatgtaatttcagatacctggcaaagattagtattcctgattgttttcaatactatgttagtggctgggtgcggtgtcttgggtgcggtgtctcatgcctgtaattccagcactttgggaggccgaggtgggcgaatcacttgggatcaggagtttgagaacagcctggccaacacggtgaaaccccgtatctactaaaaatacaaaaattagctgggcatggtggtgcatgcttataatcccagctactggggaggctgaggcaggagaattgcttgaacccaggaggtggaggttgcagtgagccgagatcgcaccattgcactccagcccggacaacaaagtgacactccatatccaaaaaaaacaaaaacaaaaacgtatgttagtatgattactattgccaaaatagtgtttcattgtttattttatttattttattttcatcatgttggtcaggctggtgttgaactcctgccctcgtgatctgcccacctcagcctcccaaagtgctgggtttacaggcatgagccaccgtgcccggcctcattgtttaaacagttgatgtctaatattttgataaataaaattaagattgtgtgaaaatggaattgtggagaaactgtaaacattcaattaatttgaactttttggtaattggcattataagcttaatacaaagtatttgtatgatactctttttgtatgtcttacattacctagaaccagtattatagtacttggtaaataatgattttcaatagattacccgcctctcccaaagctgttggaaatgtgtggggccatgttcaacatttcatgaggatttttcgcatttattaggcaggagccaggaatgttgcaattcctgcatatttcttgtgggaccattctgtatgataaagaattgtcctgccgaaaatgtcagtagcatccttatataggaacagtattctagaagacaatagttttgttttcccttctttgaaattagatcctgaataagacagttgctgcccagaagatgttcatactttggtagaaatggtagactttgtgtggtaagtacaaaatagaaatgtcttttatgcatggaggcagtgagtgatggcttttctttgaggctgttgagactttgacatttgtcttgtatagggaattgtgggagaaaactgctgatcgtaaggaatagtctattaaggttacgtatgctatattcagggacctccaagtaatttggtactgtgagaaaatagagtacaagttatagtagcagttggtgtatggtaacatgctatactaaggagcttggtctttagtgtgaggattatctggggtactagttaaaatgcagatttttggattttccagagagtctggctcgatagggtagtaaaatgagacctaggaatcttttgcaaataagtattccaggttgttagatggtgtattagttcattttcacactgctaataaagacgtatacatactgctgataaagacgtaacccgaaactggaaacaaaaaaaggtttaattggacttacagttccacatggctggggaggcctcagaatcatagtgggaagtgaaaggctcttcttacttggcagtggcaagagaaaatgaggaagaagcaaaagcggaaacccctgataaacccatcagatctcgtgagacttattcactatcacaagaatagtatgggaaagactgggccctatgattcagttacctcctgctgtgtccctcccacaacatgtgggaattctgggagatacaattcaagttgagattttggtggggacacagccaaacaatatcattctgtctctggccctccaaatctcatgtcgtcatatttcaaaaccaatcgtaccttcccagcagtcccccaaagtcttaactcatctcagcattaacacaaatgtccacagtccagagtctcatctgagacaaggcaagtcccttctgcctatgagcctgtaaaatcaaaagcaagctagttacttcctagatacaatgggggtacagttattgggtaaataaagctgttccaaatgggagaaattggccaaaacaaaggggttacagggcccatataagtccgaaatccagtggggcagtcttacgttaaaactccaaagtgatctcctttgactccaggtctcacatctagttcatgctgatgcaagaggtgggttcccacggtcttgggcaactctgccccgtggctttgcagggtacagtcttgcttccagctgctttcgtgggttgcttccagctgcactcactggcattgagtgcggcttttccaggagcacggtgcaagctgttggtgggtctgccattctgagatctagaggactgtggccctcttctcacagctccactgggcactgccccagtagggactctgtgtaagggctccgaccccacatttctcttctgcactgccctagcagaggttctccatgagggctctgcctctgcagtagcagacttttgcttgggcatccaggcgtttccatacatcttctgaaatctaggtagaagttcccaaacctcaattcttgacttctgtgcacctgcaggctcaacaccacaggaacgctgccaaggtttggggcttccaccttctgaagccacagtctgagctctatgttggcccctttcagctggagtggctgggacacagggcaccaaatccctaggctgcacacagcatggggaccctgggcctggcccctgaaaccactttttcctcctgggtctctgggcttctgatgggaggggctgcagtgaaggtctctgatatggcctggagacattttccccatggtcttggagattaacattaggcttcttgctacttatgcaaatttctccagccagcttgaatttctcctcaaaaaatggctttttcttttccacagcattgtcaggctgcaaattttctgaacttctatgctttgtttcccttttaaaacggaatgcttctaacagcacccaagtcaccttttgaatgcttttctgcttagaaatttcttctgccagttaacctaaatcatctctcaagttcaaagttccacaaatctctcgggcagcggcaaaatgccgccagtctctttgctaacacataacaagggtcacctttgcttcagttcctaacaagttcctcatcgccatctgagaccacctcagcctggaccttattgttcatatcactatcagcattttcgtcaaagccattcaacaagtctctaggaagttccaaactttcccacattttcctgttttcttctgagctccccaaaccgttccagcctctgcctgttacacagttccacagtcgcttccatattttcaggtattttttcagcaatgccctgactctactggtaccagtttactatattagtttgttttcacgctgctgatgaagacatacccaaaactgggaacaaaaagaggtttaattggacttacagttccacatggctggggaggcctcaaaatcatggcggtaggtgaaaggctcttcttacgtgttggcagcaagagaaaatgaggaacaagcaaaagcgaaaacacctgataaacccatcagatctcctgagaatagcgtgggaaagaccggcccccatggttcaattacatgtcccttccacagcacatgggaattctgggagatacaactcaagttgagattttgttgggaatacagccaaaccatatcaggtaggtaggtaggtaggtaggtaggtaggtaggtaggtaggtaggtaggtacgtaggtaggtagatagatagatatattaattactttgctgtggttccagtttttaagcagaggatatcatatttataaatttaaaaaaattcgccttgataacagtgtagaacagtgtttctcaaacttcttgactaggaccctccttaagaattaatagtatttaacattttgaataaatacatgcgccagtgtatgtgtgtataacaaaaatctgcaaaagttttttctcagtgtagtacagtctgattttttctcagttctattttgtttacaaaaaacattcttagtggagagagggagggagaaggggaaagagagggacggagaaggggagggaaggagagagaaagaaaggaaagggagagaaggagagagggctacaaagaaaattctaaattgactatgaatcactagtgggttgcagtcctcagtttgaaaaacatcggtctagattttaaagcggttctcactttagcatacatcagaataacctgaataacccccagagctgctgattcagtatttttaacaagtacccaggtgatgctgatgttgggtctagaaccgcattttgaggatcactgatttatagaggatagattggaagggcaagtgtccgctggaatgtctgctctgtaaggtcgagcatttttctcaggtttgttcactgtatcttctcaatgcctgtaacagtgtttggcatataggacataattatttgtggactgtatgacttgatgcaggaaactcaagagttgagtcactacattactactgtttgcagtactgctgggcagaaaggaccagggccatgtcatagagatgcattggaacactgaatcagaatagacaataatggtgggctgttggggtagattctgactcctaggtcgtttacatgggagtctaggtgagtcatggtgcccagtacttagccacacatgatgtgtattcattaatgtttaccattatcataggagcttcgtagaagtgatgggtcgagattgctgtgggtaaaccagttggaggtggtaaaagtgaagcataaaatttagaaaattatgatttcaaaaactttttaaacaaaacattaataagactttttttcaccttgatttttggctcacaagaaacaggctttgttttgttttggaagagaggagaagatgtagaaggtttgggtgataacagagtgtttggaagccttactatatataatacattagtcataatgtgttttatttagcatgtgagtgtctattttgatggtgcgctattctagatgcctactttacagagatgaatcagacacaacatgggatctcagaaagtagtgcttgttactacgggaagaagcgctgtctttcgcctgggattagcagagacttaaatttattcactggaagtgagtttagaagtaatcttattcagttggttccccttttgggtgaagaagatgcctaagaaagataaatgatcaggttacataaatggccaaaccaggactaactgggttcctgacttctggtgtaaggctctgttaaacagttaatgccaccaccactgccaccaataataatatattttgatcaccaactttatgtaacactgataattgttttacatagatatgtcatttaatcctctcaacaaccagtgagatagatcttgttaccatctctctaagaatagacttcaggtaagtctaaatactgggcctgccagtaagattccctaggaaattgaccttaacatttgctttctcagtaagccattagagatttagtggaactgttactagcatcatgacaacaaatctagaatgtctggaatgattggaagggtcagaagattataaaaaatctctgtgagtatgaccaggcatggtggctcacgcctataatctcagctctttgggaggccaaggcgagcagattgcttgagcccaggagttcgagaccagcctgggcaacatagtgagatcttgtcactatttcttaaattaaaaaaaaaaataaaaaaataaagaaactctctgtgagtatggcaaagggaagttcttgaaggatctgatagaagcttcaggtcaattaggcaatatgccaagagcaaatcctggaggagaagacaaagtatgtgtagatccttgtgtacagaatgaccaaatgaagttttatctgtattttcagggaatagtttgtgactttttggccagtttcttaaaaggtaaaggctctagattgaacactaaacctggtagagaggaaatgtgttaggtagaagaatgaaatcgttgcacatgttttcttttcttttctttctttttgtccattatgatttttcccatcatagaacctaaggtgaaatgagaaaatagaaatggctaaacagaaaaggattgtcaattggcgtaatggaagaaggaaggacatttcaagaagtgtggagagttgggataactactaagaccttcgggcgttgccggttctttttctttatgtaggattggacagatggaaagttaggcttttcttctttgggggattgcatctatgtatctcactgttgtaaatgaatttatgttttgtatgttatttaagaatttatgttttatatgttgcagaaaattttgtattttctatttttataaggaaaaagttccatataaaaatagtttagtaatggttttgctattataaaggataatctttgattactaaagaagttgcttgtatgaaactcatcgcttaataataactgctgattaaggaattactatagaaagttcattggaagataaaaaaaagaaacaaaatcttcagtactctgatgtggcaaaaatgaggtttgatactttaaaattttgtttttgttattgtttcacttgggttagaattacagatttgttgtatttctgtgtctgtatcagtttttaaaatggaataactttataaagagattaataaaactgttgtattcatctgtccagagttatttttcacttagaaatctttaatgttctttgccttagttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaaggtgagactggacttgttttcctacttatgacttggaaattaagtttgtcattatgaaagaagagaaatattctgcattttttggatcttgtcttttaaggggcacatggagaacctaaaaataaacaaaaacccctctgttgatttcgggctttttcccccctttctcttggctgagggatgtgtatgtaaatgtatataaatttgtatacaatgtaggttgtatctgtagagtaatggtagacaagtaatttactaattgaaagcctaagatattcagagaagttatattaatattttgttttgaaaaggctatatagtgatggatttcctaagttaaatctaaaaggtttatttactaagggatttattattttatatggtacaatagttatttgctttctctataaaacatgttctttcaaagacatgtttcagattagtttttaaaatatatcttacattctggagttttttgtatactttggcaatctgaaaattcagctccataggaatttatgtaagcctaaatggactgaattagatttattttaagttaagagtggatatataacatatcttaatttatattacttggattaaagctaagaaaaagcaaatattcatagactgtgtccatagtgccttgtactctgcaagtcattttatagatactgtttcactggcatcttataagggctttgtaaaatagcccttggctcagttttacagctgaggaaaatctgagcccagaaaaggctaagaaacttgatctgtattttctctcatgacaaacatctattcagttataaaacttcctgagcattctaattcagtgcatctgcttttatgggagaggacactagaagtaaatgaaaagttcattttaatatcatttagttactcatttgcctcatttgacagtatatatatgtgtcttaaaattggtaatgacacacagtagaagagtatttgggttattttactgttgatatctagtggtacttttcatacctaattttaatgtgtactttgtatcaaataattttatccttttattcttttttgatgactgttcttcctgttgccttcagacctggcattaggattttaggtcatcataaattaaaatttgattttcttcactcagagaatattaggataatggagttatctgttctctgaaatttgcggaatcaaacatgtaattccttttacgcttaagtaacattgccattatttctgatttgtattttttccgacttttgccggtttaccactcttcaggcaacctggtggtcccctgctttcaggaggccaccatattgatgccgaacttatttggacacctgatcagcatagcacatacagcccagaactcctgggctcaagtgatcctcccaccttagcctcctgagttgctgggactacaggcatgcatccctgcacccggctgatttgtattttttaaacagctgatgaaagtggcatgagtctgtcagctgtcatatttggaagaaaaggactatgtagatttcaaaaactagtcacaactttttgagcttacttttattggattagtaactcattgtaacagtggtatcattgtatcagtaaaacagttaaccttgagttaagacaaaattatgtttgaaaatgtccagtttacttaagaatgcatagaactatttatgtttagatgttaaggtaactcactacttcatgttcctaaattcccttgcatccttaggaattgccacttaattttttttttttgatatggaaccttgtcacccatgttagagtgcagtggcgtgatctcagcttactgcaacctccagttccggagttcaagtgattctcatgcctcagcctgacacccaactaatttttttgtatttttagtagagatggggtttcaccatattggccagtctggtcttgaactcctgacctcaagtgatccacccgccttggcctcccaaagtgctgtaattacaggtgtgagccaccacgcctgggcttaaatattttttaatgttttctagtatagggtgggtatatcacagctgttatttgccatatacatttataatgtcctgagatgaaatgattgaaagcatttgagtgcagaaaacatgaaaaacatgaaaaaagttttcatcattgtatgtaaagtgttcttgtgattataaaatagcctcatggttccttgtttgcatgttcgcttgtttttttgtagccacagcaccacaagttattgttccagattctaagttgatacagcatatgaatgcatcaaacatggtaagactcagaatgtagcagtttgattggctgtacttaattctaacccacattgtaattatgcctatatatgtcctatattaactacttgaagtttattgaagactcaagcaaaacagctgttttagtttcctgaatattggatctgaagtttagcttggtacctagacattaaggttcataaaattacggaattgtttaagaataccaaaagaatggtgctttgtgagagttattccattccctactatttccgaaaaagttttagggtacctaccaagcttataatgccaagtatggttctgtttcaggagacctagtaattgcaagagggtgggaaggctaagaattgtgaacttttaaaaaatgaagatagactggatagttcagtataactatttttaaaatcaagcatttaaaaatattactctgacttaaccatagtatagtctaataagtcattatagtgtgtaaattaccacagaatacattttaaccagctgagttatattagaatttttatatttctgaggactatccactaaactttacaagtcctcactcatattttcaaattacatttcagacatataatatttctcaacaaatgtagtataggttaactgtaaacttgaaagaacctcttcagatccttagaaaatctttacctatatccttgaagttgttttttgttttttttttttttttggataaaacattaaaatatagtcagattagagtagttcaatacttccttataaatggtttttctttattctgtttaaaatatacagactgttgatttcattgagtggtgactcagctcttacatttcattcttcagccaaaacttttatttaaaggtgaaagaatcaatatttgtaaaaagatcttttaacctatgtaactagttagtactagaaatgagatttttttttccctccgttcaagtttttttttttttttgaagatggagtcttaccctgtcacccaggctggagtgcagtggtgtgatcttggctaactgcaacctccgcctcctaggttcaagtgatcctcccacctcagcctcctgagtagctgggagtacaggtgtatgtcaccacacctggctaatttttttgtacttttagtagagacagggtttcaccatgttggccaggctggtcgcccaactcctcacctcaagcgatctgcccacctcggcctcctgaagtgttaggattacaggtgtgagccaccacgcccagcctcaagtttttttttaaaccaaaaagcagtgtatgaaaagatgagttctactttgtgagtgatactgaatcacaaagttcatttgtggtttataagccagataagaagggcttacccactagacagatgacttcctcctacacattaccagcctcacaaattcatactgtggcagaattgaaagtttctacatgatagtagaaattgcagtttttaaattcacaaatatcgaggatctctgtttgtacttgtagttgcagtttctagaatcttttcgtttacatgaaaataaaaaatttcatgcctgttatttctcacaagattttttattggaaaaaactccattttaagtctaaggccccaattttttttaacctccacccttaaaaaaaaaaaagtctcactatatgttgcttattgtagttgatgttattaagactatatcctagggaataactcacattattttaaaacaaattttggcagagtctcttgtggtaggcccctctaaaagaattttaaatgttgtggaagagaattttgaattagtaagttatttctgggataaaaattagtggtccatctcttacttactggttaagtctcctttattctaaagagcatatgtatttaaacaaatcataggtcagttactcaggaaaattgatttaacatttctgtatattttacattttactttgttgtttttagtcagtgtttccttcatgtatttctgaacataatcagtataggctctgtaccaataaaagtgttttaggtttttgtgggtttgcattattctgatttagaaatagcaaaaatatatttgttctttctaatggctctgtttgcattagaaatgaactaatcataaaaacgtgagataatatagtagaaggctatttcagggaacttctagaaaaccattgttttcggttcttttttatgaaatgattggtctaatgcattatttgtgtttgggctgttttgtggaatacaagaagaaattttaatagttattaagtataaggtggttagtgtatggtacatgactcagcaaatatatgttatgcagcttgaatttgtggagggtgtgcaggtagttattgggtcgtgtattctatatggaaactactatgtcagtttgctggtagagggagaattgctgtctttcaaaatatgaattataggcacttaatatttctaaatatttttgtttttttctttttaaatatttcttaatagtatgtggtggttaatattttccttaaacttagataacctttaatttgcttatatagccaagttttattttaaattgggtaattgagtatccaacttaaatacgaatcacccgggtgggctatagttaaattctggagacacagtgggaatttcaggcccaagatgtagaaattacttaggtttgtcaagtggcaacaagtgtattttcttggaaagctatgtacctagagcccagactagacagtagttgaactattaactcagtttaataattttctaagtttgttgacttctctgacactagcatttccaaagcagttatatttatttttttaagctttttcagatatgggtagttctaaaactgtataggttagattgaatgtatgaatggttggtagctaaagaagattgaaaagagagggaaaaaactaccaaaatgtgtagctatagcgggatacaggaaaatacttaaagtgcagaataaaaaaccagagaatggcataattctttgcgggaggacaggaggagaaaactctccagaactctccaggaagtcaagaatttgtcctggatttaaagaaattcataatataatcccgtctatatctttataacttaagtgtcacatactaacttgatttcaaaatgttgaaactaaagtttgtgactattgcccaggctggagtgcagtggcacaatctcggctcactgcaacctccaccttcaggttcaagccatcctcccacctcaccctcccaagtagctgggactacaggtgtgcaccaccctgctcagctaatttttgtattttttgtagaaatgggatttcaccatattgcccaggctggtctcaaactcctgagctcaagcgatctgcccacgtgggcctcctaaagtgctgggattacaggcgtgagccagtctgcctggtgtgacttttcttaagatttacagattttttgtattaatctgttattaatgcatgtttcacctagaatataatgccagtatgtcccttttttctttgctaatatgacatcttagaagaattgtcagctgtactcccagtgaagtcttctgatacagtgttctttatagatatctgttgattttagtagaaattttaaaagttaagaattctaaaaagtagataattatacttttatctcaaggaaatggggataaggaaacagtgggaaaggaagcaataatgaaatagccatttcatatattgtacagcattgttaatgtgggtattgtctaaaaatgtgtaggttagattgagtataggaaggcttggtaccttaaagaagattgatgggacaagaaggaaaaaaaaactgcagtacctgtgagatttacttagagcaccttctctaggggaaaaaacccaattatattgttgtatttaactgcttaaaataatttagtaggttggaggctaggttggtcagtcttgtaccattttataaaatgggatttagccttactagattttttaaattttggtatattctaaacaaaaagtttcatacactattaaaatatgctagagagaaacagtattatacatgtatgtggttttgatattttttctttgtttttttcagagtgctgctgctacagctgctaccttagcactccctgcaggtgtgactcctgttcagcagatattaacaaattcaggtaattaggaatgatggaaccattttaaaatgtaattcagaaaattgtactatctagcccttaggttttgtcttctttgaaagacagaaaatactaatatttcttttaccatttggtttaggttattaaaataactttatttgagggctgtaacacatataactgtaatcgttgttgaggatacagtaaagaagatgaaaattgtacttgaacctttgatctgtgcatgataaccctattattgaagtatgattatataaaaatgcttacttagttttttactgaacacatttaacatgccaagtgagtattaaacttctttgaacttgtgatatcaaagtaattcctagagcatattaagagcaaatttattgtatgctattattatacatagtatctcttcattgacaaaagaccaatgtctagctcatgtgttttggcatattggtgcttgaaaaatttatttacatggattttaagtgttccctataatcttgattatatagttattatttattttctattctgtgtatgttatttttgttaatttgtaaatttgtgaaattaggggcttgtcttgctacatattttaataagatgtaatttgctttttaatcaattcaagattctgggttgtctaaaggaacatattgggggaatttgattctgtgtgaattgtatgacaatgatgataactggttctgtgaacttttattgcttttaccaattttgaagcaaagttctttggtgctttgtttggttcaagatattaaatgagctattaagcttttgttcctttaaagctttaaaaatgaacagctcccgaagtgtctgatcttactgctctttcttcactcctaaggttagcaaagataatgtaagctttagtcaagtctcataatctgttgttaaaaccttgttggaaatagctgaatgaggatgtaaatatgaaaaataaaacattttaaggaatgtatttgaacatggcgagaagtcagagaaggggaggattatgcatactgtgtatgaatgacaacctttaataaaattgttagttttcttgataatttcttgtgcctttggtggtatgaaattaaatatgaattcatttcttttgagatggtcactgctaaaatgataactcggaatgcatgctttttgctttaggccagcttcttcaggtggtcagagcagccaatggtgcccaatatatctttcagcctcagcagtcagtggttctacaacaacaggttataccacaaatgcagcctggtggagtacaagctcctgttatacagcaggtaaaataatcttctattatgatcagtatggggttctgttttattctgtatgtattccctgggtagtttccctctccttatatgcacaaaagactctttttcagtgctacagacccagttgtttcaaatttctcctgtatacagcttaacttagattcagcatgtattaaacatgtattaaacaattactgttgtctctgcccatccttcatcatcccctcgaaggtggcagcactctccttccagcttcctaagctggtcattcagcctttattcaataagcagttactgagtctcggggtattcacaagggtcaggggatttaggagtgaatgacacagacatgactctagttttatgatgcttactggaagtgggtgtgtagaatcctcccttttccttacctctaatacccaaggtatcaagccctaccaattcttgttaatagtttttcttttcttttttttttttttttcgagacagagtcttgctctttcacccaggctggagtgcagtggcgcgatctcagctcactgcaacctctgcttgctgggttcatgccattctcctgcctcagcctcccaagtagctgggactacaggcgcccaccaccacacttggctaacttttgtatttttagtagagatggggtttcaccgtgttagctaggatggtttctatctccttaccttgtgatccacccgcctcggcctcccaaagtgctgggattacaggtgtgagccactgcgcccggccttttttttttctttaactgcagttttgccatggttgcagtcccttaatatgtttgacactgtttttttctcagcctcttttttcatttccttagttcatactgtccatgatttgtcactaaaatgctgcattgtcttcttaatggtttctctgcctctcatcttttgccctcctaacctggctgatttatagtcatctttttttttttttttttttgagacagagtctctgtcacctagggtggagtgcaatggcgcaatctcagctcactgcaactcccgcctcctgggttcaagtgattctcctgcctcagcctcctgagtagctgggattagtggcacgcaccactgtgcccagctaatttttgtatttttaatagagacagagtttcaccatgtctaggttggacttgaactcctgacttcaggtgatctgcccgcttttgcctcccaaagtgctgggattatgggcgtgagccactgtgcctggcctatctttctaaaaatcctaaaacttttaacagcttttcattgcctactgagaagagcctaaacaactcaacatggtttataaaatctttttgtggatcttgtttctttgaactctccaggtttatttcttgccatgctcccagttattttctttagctgcatttacatcaaaataaacacttggatctacttgtgttatattcttgtgctgtggcactaaaatgaaagaggaatggttattttcttgaggaacttatgtactttatatgtttatgtgtctgtctcttttttaaatgtcagtaaaatagtattatgatagagacaagatcagagcagtactattaatccagtttatttacatctttccaaaattatgtactgctgtcacttctgggtttcacttgatgttacacttctcttaagaatgccgtctggcaactccctgcacttcccccaaacaaatagaaaaacctggctaatctccttaaagcagcagtctcttagctttttgacaccagggactggtttttgcagaagacaatttttccatgtactgggcagcagggatggtttcggggtgaaacttttaattcaggtcatcaggcataaggagtgcacaacctccatccttgcatgtgcagttcacagtagggttcctgctcctatgagaatctcatgctgctgctgatctgacaggaagcagagttcaggtggtgatgctggctcatccaccactcacctcctgctgtgcagcccagtttctaacaggggttggggaccgctgcctttaagcacaaacagaaactacttactaataatataagtaatatttgatcatgctttgtcccctaagttgaatttggtacactctcttgtgttcccataacactgtgtcatatttgtactacatctgctgtgtttttgagttgttagtgctttgtctattataccatttttttgtcttttgtgttgttacaccacgtgtaagcattttaaaggaaatactgtgtcttatttttgcattccttgaacctaatggcaagtaacaagcatctagtcctcctcctttattataatacatatagttaatatttgttagtatatattttttcaagttgtggcttactttagaatcctagatgcagaacctggaaaggaacttcagaaatctgatctggtggtttttagaaaaataattagcttttatctcacactgagtcagaatattaggggtatggccaaggtatcagtactttttaagttgccaggtggttcatatttgcagccaggattgagaaccattaagcctagtttgacagtgaaacgacagaggccaagaggagttaaatgacttgcgtctgctgtatttatgtctgactttagacaaaagtagacccaggttggccaggcgttgtggctcacgcctgtaatcccagcactttgggaggcgggcggatcatgaggtcgtgagttcgagaccagcctgaccaacatggcaaaaccccgtctctgctaaaaataacaaaattagccgggcatggtggcgcgcacctgtagtcccagctactcaggaggctgaggtgggagaattgcttgaacccaggaggcaggggttgcagtgagccgagatcacaccattgcactccagcctgggtgacagaacgagactccatctataaaaaaaaaaaaaaaaggtagacccaggttttcagattctcagtccagtgttcttcatgtgaaggcagtgtataacttttgtcctggtagctggcatatacatagtatgtgctcaataaatgaagcagttatctttagaaaatccttattttctagaaatttgataaaatagaaatttaatgggtcactacactagttaaactaattgcttttgtactttggtagtttttaactgtgtatgaaatatggccattctggtgaatcttaagcatttgtttctatttctgtgtaccatacttgatcctcttaactagttactgttatgtggttttcttttgctttaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagtaagtttctagtaacatacttaaaataatctacttgattatttccttttttagttggtacaacactgataaattatatcctgtttttttcagagactgttaggtgctgtacaacataagattttaaagataaagttagattgttttaactttagtaaggtttttatattctggctatatttatcttcataaaatataactttcatatagctggtaataaaaaatgtataacaaattaaattgtattaatatgtgtagtaaagagtacaggtaattctaactctggcttacgcatttataatgtggcttaaacataagacattggtagataaatagatgtggttaatcttttgcttcagtaatttaaaaagcgtggcaacatttggggagagagcaaactcaagaaccaaatgtcacaaatttattaaatatttaaaaccttttggtccatgttctataccacttccttaaaaacctatgtacccttaatgtctgtgttcttctagaagcatataaatatgcctttgttttcctcactatttcagcttagttactaggctccaaaaactatttgtcccaccacaattttcactgttaattgccttcgttagcctaaaatgcagtctttttgtttcttagtacaaagttcttctaaattatctaagtaattttttttctgaagaaaacatagtttattattgaatattgaatagacacaaatgaatagaaatgtttcaagataaaaatcatcctggtgcccaccatctagttaaaataaaattccattatttaaagtgccttagatgcctctccctaatcccatcattcctaggccatcaaagtacctttgctcatacatttgtgttgattattaattgcttttatattttaccatatatatttatattcctaaatagcatattgtttagttttgcatgtttacaacgtaaatgaagtaattacgtattcttctgcaagttggttttttccccttaaaatgatattcctgaggtttatccaagttgttgcatatagctataattattttcattgctgaatataccataattttatttgtcaatttttctaatccagtggacataaggattgtttcttgttgtttactgttacaaacagttataaaatattgtagtgtatgtcttctggggacacaaatgcaagaggttctctaaattttataccgaacattgaacttctggctcctaagtcatgcacatctgcaactttataataaaatgccaaatcacttctgccattcaatacataattgtgcagatgtccatacccccttatcaatacctgatagtgtcaggcttcctgatttttgctggtctggtaggtagaaaatagtattatttcattttggttttagtttgcatttcctcacttaggagttttagcctctttttgtatatttatttgatatttgtgttttgtatagaagtgcttattgaggtctcttgcccgtttcctccccctaaattcttcatagtttcagtgcttcttgaagtaacatgtttttattaccttttccagtttattggtaggatggaaatatgtagcgcttttaatattcatccttgaaccagccaccgtcctaatgtcttttgttagtcctcataatgtatctgtagattcttttgtatcttctgtgtagactttcacatcttatatgaagaacggcagttttttgtggctcattggctaagccttcgggaacagtattgattagaagtggtgatagcaggcactcttctcttcttcttaaactgaaaagtaatcttttccatgcttcactgttaagtttaatgtttgttgtgggttttctttttttttaatggatatcttcatcaggttaagtaaattcccttctttgcattgctttgttttttaaactgtaagtgaatgttgcatttaattaaacaccttttctgcaatgatttgtataatttctcacgtaatgttatttataatggatttcattaattgattttctatttgtaaaccaatcttgtactcctgggatagcacaacttgatcattttatatttctctttttataaattgctgaattcattttgttgaggacttttttgtagatatttatgattgatagatactgtgtgattttctgttctcatactcttcttacaaggttttcagttatggtagctttgttaaatgaatttggggacatgtttcctgtattttgaactcttttttttttttcaaagattgtatttaattcttctgttgatatttgttaaaacatgacactacagatacctgggtctagtaatctcatgcccttcaagtattttgtttctgtttgagaccgttttgataagttatatttttctaggactctctatatatttatctaaattttcaagttgattaacatgaagttaatcatgatattgtctttttgatgccagaatcctttgtcatcttcattcctaatataattattgtgccatctttttttttccctgttcagtcttaccagggatgtgttgattttattaatgttttcaaagagtaaacttttagctttattctctctagtgtgtttttcccattctattcttttctgacttaactgttttgtttgtagagaatatgatctgtgtgatgtgtgaatcttttgaaattgcttgagacttgcttgatttggtcagtttttgtatatgctttgaaaagaatgtgttttctgcacttgtttggtatttgtatgtgtctgttagatttatattgtcagtaggtttgctcagatgctctttatgtatccttgatattttttgtgtgcttgatccattttttttttgagatggagtctcgctctgtcacccaagctggagtgcagtggcactatctctgctcactgcatgctccatcccccgggtttacgccattctcctgcctcagcctcctgagtagctgggactagaggtgcccgccacctcgcccggctaattttttgtatttttagtagagatggggtttcgctgtgttagccaggatggtcttgatctcctgacctcgtgatccgcccaccttggcctcccaaagtgctgggattataggcatgagccaccgcgcctggccacttgatccattttttactactgagtgagatatgttcatgtttcctgctatggtagttgatatatttcttcttgtttttctgccatttttcctttttgtattttgagcctcaaaacaggtgcatgtaagtttaacattcattgttttttctcagtgagttgaaccatttatgatcatacaatgtcttaagttattgctagtaaattttttttaaccatgaagtctgtttgtatgatactgttagagctgtaccagctttgttgtggttagaatttgcctggtacagcttttttcattctttcacttttcaaacattttggatctgtaaacttaatctttttaaaatagaatattgctatttatgctatttgttgcaaaactttaacatcaaccaagactattcagtagggacagaatagtcttcaacaaattatgcttggacaattagatatccgcatgcaaaagagttaagttggacccctacggcataccacatacaaaaattaaagtggattagggacctacatctaagagctgaaattataaaactcttagaagaaaacataggggtaaatctccatagctttggcaacagtttctttttttttttttcgagacagagtctcacgctatcgcccaggctggagtgcagtggcgcgatgtcggctcactgcaagctcagcctcccgggttcacaccattctcctgcctcagcctcccaagtagctgggactacaggtgcccgccaccatgcccggctaattttttgtatttttttttttagtagagacggggtttcactgtgttagccaggatagtctcgatctcctgacctcgtgatctgcccacctcggcctcgcaaagtactgggattacaggcgtgagccattgtgcccagccgcttgcaacagttttcttagacatgacacccagagtacaagcaatcaaagaaaaagtggactttgtagattaaaaaggtggtttttgtttttgtttttgtttgagacagaatctcactctgttgcccagactggagtgcagtggcatgatcgtggctcactgcagcctcagcatcttgacctcccgggctggagtgatctttctgcctcagcctcctgagtagctgggagaaaatatttgcaaatcatgtatttgataaggatctactatccagaatatataaagaactcttaaacagcgtaacaacaaaaagataatgcaatttaaaaactggcaaagaacttgaatagacatttctccaaagaagatacacaaatagctaacaagcatatgaaaagatgctcagcatcattagtcattagagaaatgcaaatgaaaaccacactgagataaccactttacaccttctagaatagctatactcaaaaaagaaagagaaaataaatgctggtgaggatttggagaaattggagcccttgtgcattgttggtggaaatgtaaaatggtacagctgctgtgggaaacagtttgatagtcctcaaaaattcagtatagaattatccatatgacccagcagttccactcttaaatatatacacaagagaactgaaaacatgtttttcaacaaaaacttgtatgtgactgttcatagcagccctatttatgatatccaagtggtataaacccaaatgttcatcagctgataacagtggaatattatttagccataagaagaatgaagtattcgtatatgctacaacatggatgaaccttgaaaacatgctatgtgaaagacatcagccacacaacgccacatattatatgattccatttatatgaaatatccagaataggcaaatccatacagacagcagattatagattgccaggggacagggagaatggggagtgacagcttaataggtaagagtgatgaaatgttctggaactaggtagtggtgagtgttatatacactgtaaatgttcattgcacctgaattgtacatgtacaaatgctaaaatagtgaatgttgttaacttgaattttacctcagagatttttttttttttttttgagacggagtttcactctgctgcccaggctggagtgcagtggtgcaatcttggcttactgcaggctccgccttctgggttcccgccattctcctgcctcagcctcccgagtagctgggactacaggcacctgccaccatgcccggctaatttttttgtatttttagtagagacggggtttcaccgtgttagccaggatggtctcgatctcctgacctcgtgatctgcctgcctcagcctcccaaagtgctggaattacaggtgtgagccaccacgcctggtgtagaaaatttttttcattttacattgatgatacctattttaaattaaagaatatctatacatacacacctgtgtaagtaggtataggcctagacataataattttttttttttgttcttattgttgatatagagtctcaggttgttgtccaggctggagtgcaatggtgtgatcaaggctcatagcttcaaccacctgggttcaagtaatcctcccaccctcatcctcctgagtaggtgggactataggcatatgccaccatacctcgctaattttttttattttttgtagaggtggcatctcactgtatttccctggctggtctcaaactcctggcctgaagtgattgtcccgcctaggccacccaaagtgctagaattaacaggcatgagccactgtgcctgtccataatatagtcttgattattgtcttctctactttggttttgtcttctctttctgcatttattagaaatctcagttacatcttctatcttctgtcacaattgaagcgaaatttaacatggttgtttattttatgctctagttaggttttatcttggcccctaactctctttaatgctgagatttcctactttctgcctttaagaaaaaaaaaaagtctgaatcttaattctgcttcatacctctaccataaccatcatcatgctaaacatgctgatttgtatttagagtccaagttctttaatgtaaagacagcaaggcagactgctagcctattgcattgctcttcttttctcctctaatttctccactgttttctgttttatatgatttgtagtacatagtgccattagctcttttgaaccttcatattaggtccttttctaggcatcttaaacagttattgtagagaattatcttcttgtactgtttttaaaaaataaagaaaataaagataggccgggtgtggtggctcacgcctgtaatcccagcactttgggaggcctaggcggggtggatcacgaggtcaagagatcaagaccatcttggccaacattgtgaaacaccgtctgtactaaaaacacaaaaattagctgggtgtggtggcgcgtgccagtagtgccagctactggggaggctgaggcaggagaattgctcgaagccgggaggcagaggttgcagtgagccgagattgcaccagcctggctacagagcgagactgtgtctcaaaaaaagaaagaagaaaataaagataaacatcttttcagacttaaaaattacatagcttagctaatttaattatatttaatttcttacatttcagtaatattggcaaactgttaacagctgatttgacaatattaaattcatggcgtacatatatgcatttggcatttggttctcaaagaacatcaaggtcattatattttttttttcagtgaatattaaggccttcttatagtaataagaactctccttttatttgtaggagcccctcaatagtgaagatgatgtgagtgatgaggaaggacaggaactctttgacacagaaaatgttgttgtatgccaatatgataaggtaaggatgtcatcttcagattactgacgttatttgtgttgtaatttcttccctacattattctttctgccttattgaaacatttgggcagctgattcatgcctcttaaattcattatgaatagtacgaaaaccctgttagagttttgtggattattttaatagaatgaaagattaatttcttagctttatgtttgaaaaataagttatgaatgaaatgaaaagagctacgatcttctttttctatttagacagtctttgaacttgtaagcagagtaaacagccactttgaggttgtcctttgtggtaatagctaactcaatgagataattctgttttctatttagcctcaactatctcaaaactagaagggttcaattgaatctctgtaactgtttttattattaaggaaaagactaaggcaatgaacagtgctaaaaacaaacataagtttttactgaaaattatttaaaatattatttaactttgctgtagtttgctaacattaaggaatttttaaaccagatactgtgaaaactagccattgattccttattttcttaattcctagacagggtgcttctttccaagtatttttgttacatttatttgtattatttctgagatttttgttttcaagacatttaaattgtaatacagtttttttattgcaatcattaaatttataatgcatgcaaatattacgttgcatttataattttagtagagatctttaccaaatgctaaaaattctaacaaaagcttatttattcaacatttatagagtgcggaaatttaccagacactattctaggccctggcgatgtagttatgaacatgtaaaattcatgccttgcatgaagtttcctttatagatgaagaaaatcttaattctgttgcttttatggaaatgaatgtgataagtagccgtgcttacttcaaacagatctatagggagaatgccaacactatggatcttatttactaataaaaaggtggagttaggctagttttaccagtgaagttatagaatgaagacagtaaggtcattgagagtttcacagcattcatttttgtgcataatgacttctgagagactgttcttaaaaccatataccatgtgcagtataataaatgtaatttcctgttagatacacatagagcaagactatgaggttaaaacaaaagataccattaaatctttattgttaggaagtctcagaggatctccttgcaaccaaattatccagaacacaatttcatgatgagatgtcagatttatcaggcaagcgaggacctttgttttagcctgactgaagaatatacttttaagtgtcttcctactttaagacaatggttgtattctcctttggcacaaactgtactcataatattttaaatgttaaaattggtttgttttgctcccagagacattactttactgttttaaattagtaagtgggagatagctctaaatggtgtgctgaatgataaataattttaaaatttgcagaggtctaattttgagaatcaaatgaattgctctgaagattggaggagggtggtggcttgatgtctttagccaatagtaaagaacagcagttttctttgactgcgcaaaatgaggttggatattgtttgagccaacttgaatttcaggaatgtagttttgaagccttaactttagaatgtcaacaatgagtcaattttagaagagatcatagaacgactaataaagcttgtattgccaatcaaatcagaatcttagttaaatgctaataatatggtagagttcttgcttacgtgtgggtggataagggctgatacagcatttagcgaaaatagcatcagatgtaggtaaacttgctttaacacatttttaattaggaaatttaagagggctttctcctggctttaagaatattccttcatgaagggcttagggccggtaaatagattgctttttaagttgtgactttgtacttctattaatataaaaatatttaccatttattacccaacatgacttcagtgttgactgtgtggattagttggcccatgaaactttggtacatttattttttgcaaattgtcctgtcctatgacagaatgcaggcagtttctttacttgtctatagaatctcttatttcctggctactcatcactttcttgtttttgtctagctaagcccacggtctttctggttgcagtcacttggttcatgctggaaatacatttgtatacacgtttgtagaataaataatactttataggaattcaaagataaggggagacagctcttttcatgtgcaacagatactgtttatgatgtcccttggcactattcttggagcttgagatacactaatgatcaaaacagaacagtccctgccattgggaagcttactccaatcaggggagatagatgctaaaacataataaattaggatttatttacttatttaaaacataataaaatatttatatgttagaagctgatagtcggtatggaaaaataaagagcagggaaagaggacaggtttggtttcagttttaaataggatagtcatagtaggtctttggagaaaatgacattttagcaaagacttggaaagagttagccctgtcatctggtggcagagtctgttgtatgtgaggaacagcaaggaggcctgtgtggctagactggagtgagggaagaggagagtacagtagtaggtagagaggtaagggaaggcagatagtaaggattttgtaaggacatggctcttactcttaagtgaatcagaaagttattggaaggtttcagtgagacaaatggtatgaactgatttaaattttgaaaggattactttgctttctttgtagagagcataatatgaggaggaagcagaggttgctgaaacgagactatttagggggatattataataattcacatgggagataatgatgactcggcctatggtgatggtattaaagttggtgagaagtagttggattttggatttgttttgaaggaagaatgttaacagcatttcctgactctgagatttgtggtagaaaagaaaaaggaatcaagaatgactcttgagattttttgatgaggattctgaaagaaggatggtgataccatcagttcagatgaggaaaagctgcatgtggagctggttggacatgccaagtctggtatgtccgttagacattcaagtcatcaatcttaagatgctacatttagcatttatgtagtgtatttagaccagagatataattagttcttaatccaacagtctttaccctacctgctgttttacctttattgtgctttgttttgctttaataagtaagcaaagtttgaatccagaagaagaacatgagagtagtttccaaataagatgaaggttgtttgattgagtgattttttttttttaagtctcaaaaagcagagctaggatcaataaatggaagttggagaagcagatttccgtaagggtaaactctgaaagattttacaagagagctgttccaaaaaggaataacttaatttgaaattctttgctcactgtttctaatcgtatttaagcagacactgcacaaccatttgccaggaatatgtcatgaagaatgtttgcactgggaggttaggccatggaattttaggaatgagatctcagaaaatatctgtacctggccgggtgcagtggctcacgcctgtaatcccagcactttgggaggccgaggtgggggatcacctgaggtcaagagttcaagaccagcctggccagcctggtgaaacccatctctacaaaaatacaaaaattagctgggcgtgatggtgagtgcctgtaatcccagctactcaggaggctgaggcaggagaatcacttgaacctgggagggggaggttgcagtgagccaagatcgtgccattgcactccagcctggataacagagtgagactctgtctcaaagaaaaaaaagaaaaagaaaatatctatacctgttgagcatttctgcattattatatgaaacagactgatttagtaaaagcgtactggaccaagacttgaaaatcatgattgtcacttagtagcagtatacacttggtcaaaccattgaaccctatccaatctgtcatttcttcttctgaaaatgaaagcctgaactagttgatttttttttttttttaggtacctttagatcatagaatagggagaaccagggggccttctttgcagaagatgtggaacttgaacattaaataattagtgtgacttactgggaaaaggaagaaaggtcacttcagttcattaagttttacaactcctctcccccaccaaatccatggaattacaaacaactacggactataagtgaaggcaaagatgggagtgcccagagcctgcccttcagctctttttgtttaactgtggatgtacatagtttttgaaatctggtgtaagtgactggatgattagcatcctttagatgtatttttaaaatactgctatgtataaggttccatggtagttaggtcttgagaactctataaggagttttattttggtagaagaaatgagtccataattgtattacttacaaataatgtaagaaatgtcaatgaaaataccattgggaatttaacagtggaaaagaatagttttagctggtaagatttgggaaagctttgtggaggatagtctttttgaggtagaccttgaaaatatatatgcaaacctggtagagagataagacattttgtaaagaaatattttttaactactttaatgaacacaagtactaaaagctataaaatagtactaattacagataaatttgtttttagacccacctagtgagttttgtgtgtggtttttttgttgttgttgttctttttggtgaaattaaactttattaagaaaccaatttttaggccaggtgctgtgactcacgcttgtaatcccaacactttgggaggctgagatagaaggatcacgtgaggccaggagctcgagcccagcctgcacaacataggagacccttcttctacaaaaacaaaccaatttgcaaatacaatactgtaaatactgttttgtgggggggtgtgtgtgtacgtgtgtgtgtgtatgggttttttgttacttgttttctctgttttctgattgtatctctcaatttttaaaatgttgtttttgtttagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaatgtaaagcggacagtttgaaacttggggcatatgccaaccaaaacttcgtttctgcatgtcagaaaagtgcagtagaagcaaagctactggaacaaagatagaccttgacaacatagacactacttactggcaagccatggaactgtagcacctagggtttttgggtgggagggttggggttttgtgtaggaaaaccataattgttgattttaaatacaggtacctgccaccggtaattagcatgtaaagctttgtctatattccttcctccaacttgggttcaatcagaagatacttgttggaatgaactgaagaaacttcccttttgatagattgaactgaaactgcttattgtatgtggttatatttggtaaaagttgcgtgtgagctttttacaaaagggtaagaattgtgttgaattttaattcacttgtataagaaaacaatttaaaactctcataataggtcttaaatatttttacttgctattctccctcagtgatatatacctcttcctttccagctttatgaaacatctatttaagatttaaagttatcagtgatcatagtttggagataaaatttgacccaggaatgaatatttattttaattaggttttcatacttattaaatgtaattaaagacttgggtcttgtctgagttcagtggaattgaaaccacaactttaatttccttacagaaaaacttaatttgtttcttttagtgccacaccttaaaaagaaaccccaaactagctcctcaggaatatagttttattttgcaagcataccatctagctgaaattgtatacacatgaatatatgtagacttttcctgttgggctgaagtgtgtgcttataaatgtgtttagtttttaagctaaacattcagttaacagtctgtgcattgattagcatagggcaggtggtgaggacctggatttttattaaacagtttagtaattataaaagtttcttgtgtttactagtaaagaattttaaaaatctattctaattcaacaagtttttaaaatcaactttgtaatttgaggggaaaatttggggggaagaggtgggtgggccactaagttacctctctttcatttggtggcccttccaggccattgaaaataaagacgttggctccagtttgcacattgggaagaaagcatagaaatttgacttgtatattaaaaataatagaaatgtaatatgtatattaagaatgcataggtctgtattctgtaaggggctctgaagaacaatatggcactgctgtgttcagtgtgaattcactgcctgggagaactgcaggaatgcttgtcttcaccattgtgttcttacaacgaattcaactttccatggtttatcttgacaaaatttacatgtgtttaggttacttgtatattgatatatttttttaatcttcagtttttgtcttccttttgcctttgtgttttcagaagtaacacatgaacactttttaaagtacattacagagaagaaaactgtgagctattatatagtgtttcttttttaacacaaatcttttaactttaaaaaaaggcaaaaattttttttttctacttcccacccagcttaccaccttgatctctttaacttatgttctaaactttggtgttaatggtggtgtctagcatgctagtagttagattttatttagatgccataactggtaatacagcttttattttgactatattaatttagttttttgaggggaagtttgtttattctgtgactctcaaagcacacagaggttttaaaatatatattattaagactgagagaagaggaaatgggagggagtaacatcacagaagtgctgttgttcaactgttcttcaatatagttgctagtaggtttgtatttactcagtaaggaagtcagtgacctgaactacctataaaaattcagcagtgctgcagtgttgcttaagtgaaaccctttggctatctagtagtttttatgctactgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaatgttgcttgctttgcttactagtatatggcattgttatagataattgaataaaatacaatttagaaaggaaaatgctttacattgttaatgagaattccatttaacaacaacaaaaagatgctaaattctgtaccttaaagataagtagattgagatgtcaatttgaattagtaaactgtgttacaaatgattaatactagcttttaaaaagttgtattttccaggcacacaggaatttaggttgggcgaattcacactaacaaattataactaaaaattggtataattaacattgtttttcaaaataaagattactccttgtgaaatattaataattaacatattgtattaaataagtatttctactccaaagtatagattacttaggataaaaacattgttatttctctgtttagtcaaaccacttcctcttagttcagaggttataaataattgcatattaggagaattggattactgaggtttgtattgcgtattgaatatattttgtgttattttagaagataataattagcaggtattttaattttatagttaattcagctgaatcattaagaagctcgcctttttgtatttttttatcctgttaacagactatctagaaaacatgcaaattttaactattaacataatcataataaagatatcttatttattgccagcaaatcttgtattttgcagtttaattcaagcccctactttgattaagcttaagcttttggcttttgtttctccagctgtaaaatgacaagattttgaggatgaaatgaggtgtgatgcatgtaaagctcttaggctggtgcctggtacacagtcagcactcagatgtcacaattatatgcttaatttcatacttatttgcatagtttaaaattattcttgaaccggaaaaaattaatggtcaaaaatagcaaaaacaaattgagaaccagtgaaagagttcattataaccaaacaatcctgggagggtaagttggtgaaacaatgcatctggctacagcagaaagtgtcagagggaagaaaattgagtgctgggtatgggagagggataatcaaacagtgggagggcctttaagctccctctctccccccgccaaaaaaatcctaaattatatgtctaaataagttgaattttctcaaagctaaaactatgatagaactatcattttaaaaatggacttttccaaatatgaatggagtctgtccagttcatttaaggagcaaaacagagttgtcaaacattgaagatacggatacatcactctgattctcacaatgtctcctccactttgaaaaagagtacattgacttctctgtgttgacaggacctccatgctaatgatgcataggttagggtggcattgctgagtggggcaaatagggccaggaaaactaaagttcacccaggttagttgcaagagatgaagagagtaaagctttttttgtttttagagacaagagtctcgctctgttgcccaggctggagtgcagcggcaccatctcagctcactgcaagctccgcctcccgggttcacaccattcttccggctcagcctcccaagttaactgggactacaggttcccgccaccacgccttcctaattttgtttttgtatttttagtagagacggggtttcatcatgttaggatggtctcgatctcctgacctcatgatccacccgcgttggcctcccaaagtgctaggattacaggcttgagccactgcgcccggctgagagtaaagctctttagagctgttcactttcagcagggatgtacaagggacatttgttgttttggcttctcagtgtcagaatacccttcctattttgcttcatgccaagaagaatggagggtaatatatacctctttatggaagtagaatagcaagtaagaagtcacctgtcactggatccagaaacagggaccaaaatctgaggtggtcagactgatgcttacactcaggactttgagtcttaagagcatgaaacaaagttgcaggatcagtcagaggtcctatatatgttcaggtctggtggtgtgatattgactggggcaagagtgctattggcaacctcctaagcagactttggctgcaaactactgtacccttccaatcccttttctgcttaaaataagtctgtttctgttgtttgcaaccaagaaagaaaagcattattcatgcaaagtgtgtcttaagatatcacctttcccttgtaggagtcttttgccttcccaattagccccttcttcccattagacattcaatatcctattcaaaaatcttcagtgaattaccaaaatagcaatacttgtaataccagcatcacaattgtggttggctgattatcttcgaacataaaggagtttgttacatttaagcccattatattttgtgtcattcatgtattccgcaaatacttgaatacctactatgtgtaccatgacaacccatattcaaactccctacagtcttggtgaagtgactgattggtagaattggcagagtcccttcaagattcttcatcccttgcatagcatctctctctgggggccaatcggcctcagtggatgaggccactggaggtccatttgtaggagttgaaagagcacagagactccaaagtccttgacatcttcctgaacttgttctagcacaaatctgctctgatcaactttccaagacttcctctccttcttggtgtgaaatgtataaggaccctgtgctctatcttgagatggcactcagcttttaagttctatgttataaagagggtgtgtgatatatatacttagtgttattttcatgttcttaaagcctcctttttgacatgctccatgtgttctggagcctttccatagaattcgtctcccacaaccaagagttcctgttctcagggagggtattaaaggtagaagaaggacactgaaagattttacagacacagcttttgtggagcagagagaagtgtttggaaatactggttttgaagtatgcagcaagtatgaagaaaacagggatggggactcggaacaaatacttcttgagtgacaaatgcattgcctgttttttcaaatacagtagtcttgagggtggttatttttatcttcattttacagatgagttgatggagctttgtggaggccaagtaatttgcctaaggccacacagcgagaccatagtttgaagctagggcagattggcagagtgaggtcaagatactccatccctagcttaggatgggatgggtcttttcgtcacctcagtttccaggaacaaatgtttccatcttagctacacctgttaataagaggctgtggccttgcagccaacctggtctcttgtttctgttcagaggagatattctggggacagttcttcactctccactgtctgtactcaccactctgaaaagacagagagacaaataaaaacactggctgggaccatgacagcaaagtccttctgaagagtcattcagtgaagacttgggggttggcaaagtagtcagttctgtttttgccctctcctaatagttcaatgagttaaaggaaaagaatgttttcacagaaaaaaaaaaaagtatgtttgtttgcttgaaggagatctgtctagccttacctcatatcacttcccttctggtgaatctgatggtgaaataagtttattcctaagagagctccctaatgcaattaaagtgggcgtggcttctgcgggtttcatggcaggatgcatcaggaatatagaaacttggagacaaatgtcctgtggttattgttatggtctgaatgtttctacacccccaaattcatatgctgccattgtaacccaaggtgatggtattagacggggtgtctttcggcagtgagggcataatgcacttaggaagagactcagagaactagctagccctttccaccatgtgagagtgcaacaaggaacagactctcaccagacaccaaatctgctggccccttgatctgggacttctcagtctccagaactctgagaaataaatgccaattgtttagaaactaccaatttcatggtattttgttacagcaacctgaacagactaagacagttactgaaaaaccccactttaaatatgtgagcatgggagcccacattgctggacagcctcatggtaaagctatcaaatcctgctcttggcatattttgcagtagtgttgtgcccagggaggggggcagtcagtcctgggggacgggcaataaggaggtgaactgctggccgagaacataaacacaatcattattaaattgattacatgtagtgtgctttttattattaccatgtgccagcaatcctaaactatgtcaatgatagaacaccttcccataagaaataattttttgttctaactggtctaattgttacagttagtgttacagttagcgttgagagtgtttttccatttttttttactgtgataaaatatgattaccattttagccatggttaagtgtacagttcagtggcatgaaacacattaatgtttagttttaataaaatatttgttagcttcattttttttttacatttcacatacatgaaataagccaatcacaaaaagataaatactacacaattccacttaaatgaggttatctacagtgatcaaattcttagaaacaaaaagtagaatggtggttactccggactggaggaagcaggaaatgagaaattgttcagtggatacagattgagtatcctctctgaagatttgtatatttaaaatttttttctttatctgattgagttgatttgaagaatcagtttttgagctctgagattccacagcttgatctattcctctgttaatgcttccaacactattatgaaaattttgtagtgaatttttaaattccagttcagtttggttctttttaaaaatggctattttgtctttcaatttttgggtcatttttactggattccttggattgggtttctacttcctcttgaatcttgatgagcttctttggtatccagattctgaattctatgtctgtcattccggacatttcagtccttgctgaggggctagtatgcttatttgacgttttgaattgccagagttcttgtgctgactcttttgagagggctggtgttcctttgtcgtcttgtttttatattattcatttaccttgagggcttaactgtggtatatgttgagtatagtcaattggcttcatttctggatactttcagagggccaaggctctgtatgggatctttgtggctagattcttgctctgggttttacaggtgctctatactggcagaatattttgaaattgtaatttcggcggcaaaccagtagatggcgcttaagagtaattgccggcaggctctgactcagcgctggctctttggtattttgtattcgcagtcatgctccatagttcaggggagagagatgatccttttgccaagtcctctcctggcccttagaggagccccctccaatcactggagctgcacttacgtttcctttgttaggtgttcggagctgtgggggctctctccggcagaggctaaggcttgcagacaggccgcaacccttccctgaaaggccctgagagagacaagtctcatcccgcgctggcccacgaactgcttctcactcctcccagtgttctgagtggaggctcctcccccgcgcttgcgcaccagccacaggtctcagctgggcactcctgagctctgtgctgcaaccttggggcattgggctctgtctttcggcccctcggggtcagacccctgctgtgttgggggatccgaagtgctcccaagctgcctggaaagcattcaggcggggtcgctagcaagaactcaggctgggcagcggaggcggcacagtgcacacactcctgcaggaacaaccagacaggggctttgggaggggctgcgtgcagggggtcccgcagaacatatgcgccccagtcccgcaggaaggaccgccctgctctctcttggctcactggtaagttgaggtcagatggggagccttgggggataggcgcctatagccaccttcctctgcagctgccatgcacacaaaaccccctgggctccctgcaacctggagctctgtctctgcctactccctgggcagatccccctgccaattcaactgtctgtgggggtcataggatctcttatagctgggatcccagaaatacgtgaggagagtgggctgccccactgtcactttactcaacccttccctaggaaacgttctgggcctggaactagtcctggcactcaccccgcgcagggttcccagcttccttcctcttcagcctcgtgtctgtgtggccgctctgtggactcagcgtttcactgcgaagatctgctcagagtgtgttggtttacgggatattttggtgtctcggtgggagcagcacttattgactgcatctgttatttttctgggaaaaatcatctaatcaagatgtttctgggagcaatgtaacacaacaattcaaacgcaagaaggcatctcatcttgagcaaataaataggaataatgccaaatgctttttatgtctcagacactacacatgtatgaatctttaaataacccaatgcactacgctttagatttctccccattttacagataggaaaagtgaggtacagagagattgtagactttgcccaaagtcacacagcaagtgagtggtggagtcaagttggacccagtctgacttcggagatgactacttacccattaagagcaggttcctcattaaaaacgaggataaagaccttgttagtgtattcagagtactaaggggaaataattcaatctaggaacctagacccagctaaaaatattatttcagtcaggatgaaataaagatattttaaaataaaaactgaaagtgtttattatttacaagttctatccaggcagaaagacctagtaaacaataaactttagaaaaaagattatggaaattcaaaagaggatgaaagaagaaatggaaaacaaagaaattggtaagcatgaataggtcaaaatattgactgtgagagaaaaattagaatgttaagttttaaaggaaagtggaagaaatataatgcataacaacattaaattgcttcatgaattgtagacaataaagacttctgtgggaaaaaaccacactcaaactcaaagtgctttttctattctctctcttaacaacaatcaacacagaagatgtctgtgaccaaactggggtggaggtgttcttcctgctactaagcaagcaacaaattctacaattctgttgtggcttacctggagatagcatcagatcccacatgttgaggattcattcccacaagactgcccctacttcacatgtcagttgcaactccaggcctccagaatttctgaccaatcagcttcaagttggggttttcataactccctctttgggttcaattaatttgctggagtgggtcaaataacccagggaaacatttatgtttactggtttgttataaaagatgttagaaatgatacagatgaagagaggcaaaggcaaggtaggggagaaggggcatggagcttccgtgacctccctggatatgccaccctttaggaacctccatgtgttcagctatccagaaactctttgaaccttggtctcttgcttgagcctttcatgggaacatcattgaataggcatgactgacaactgtgtagaaatgtgattggacaaaaagagtatggtctaatactcatagactgagaggggaaaccctgtaaggcctgtctgttcagattccttttggcccctctgtgtaggactccttcttttagggtatggggcaagatcacttctgaaatgagggtcttacgtcccacagtcagacaaggtaggtcagagaattcctttatggccagcgccaatatagaaaaacaaggaagattcctcacttggagagaaaaaggagcaggtgcaaggagggcaggagaggagcagagagacattctgttttctcaggcctgcttctgagccctaaagtgctccaccattataccaagagctattggagttatgagccaggaacatggatggaaacctatatgtaaaaccacaaacacacagtaataacaatataccaggatcctttaaagaaacgaagacatctttaagcttttatttcagtttagtcgtctctcttcagagggatggcccaataaaacttccttacatataaagataaagcaaaaactcaaagaataaaataatgatgccaaaaatgttttttgttgatgccaccattattaccctcctaacccgagttgattctacttggaaaatgcacactttgcttatttcatttttgtttttttaccttgcactggtggaaatctaagatgacaaagacagtgttcctatctctttatgcattttcacttatattcattgatttagtccaggtaattcttttttttttttttttcttgagaaggagtctcactctatcttgcctaggttggagtgagtgcagtaatgcaacctcggctcacggcaacctccgcctcctgggtttaagtgattcttctgtcagcctcctgagtagctgggactacaggcgtgtgccaccacaccctgctaattttatatttttgtatttttagtagagacggggtttcaccctgttggccaggctggtctcctgacctcaggtgatccaccagctttggcctcccaaagtgctggtattataggtgtgggccaccgttcctgaactagtccaggtaattctcataattttattagttagatagcattaatacaggtgtcaaaaatgtcagaattatttcttttaagaaaaaagtgttgtgaaggtttctttattttcttttcttatacattaggcattaacagtgatttcctgtgtaatttgggaatgtttattgacagtaatgtgtattacgggaagataaattctattttttcatgaaatggctgtcgtagaattataattattattattttgttgttgttgttgttttgagacagagtcttgctctgtcgtccaggctggagtgcagtggcacaacctcgactcactgcagcctccgcctcctgggttcaagcaattctcccacctcagcctccctgagtagctggggttacagcctcgcatgagcacgcctggttaatttttgcatctttagtagagacggggtttcggcaagttggccatgctgatctctaactcctggcctcaagtgagccacccgccttggcgtcctaaagtgctgggattacaggtgtgtgccacctcacccacccatcaaggaatcattaaaaagaaggaatctaagactattttaaaaatttctctcaatgatttaatatttgggttttatgtattttattccattttagcactgtgagatagcatgattgcctaaaggactgtattaaagatgagtgcacagttctgtcttatttatctgctgtcacattgttttgacacagaagaaagtcaagtaacattgatgaagagctaaaatatgctctaactgtggaaaaaataaatataaattgtccatagttgctcaatttctaaagtaaaaggaaaaaatacagtgtaagactgtgaattagttcaggaaggtaaacttaagtaatgtttatttaacttcaagatttcagtggcttaactcaacaaaggtctgcttcttctgcatgtcacgggacaatgctggttggtatggatggctcttctccatgcagtaattcagagacacaggcttctttcatctagtgatttatttttccctgcagcttcagatactctttttccctctctctgggatcctttgcatctgtctggcagatatggagacggaaagcacaagaggattgtgttaggagtcttaagggctggatgtgacactccttgaaagggaagctggggaatgagtatgtaggtgtgtgtccaggatgtagggaaaatgggtttggtgagtatacatgctggtgtttgctataagagagctaatcatgactttgttttgcaagtatgaaaagtgtgaaaaagataacatgaatgataaaatcaggcatggtcacatttataattgatcattgatgttttttccaagttaattacttctgtgatttcttgatagctatcagcatgagccccattgcctaaacatgatctcatttatttatgtgtttgaacaattcatatttttttatgttttgtagagatgggatcaccctatgttatccaggctggtctcgaactcctggcctcaagtgatccttccaccttggcctcccaaagcactgagatgacaggcctctgtgaaccactgtgcctggtctcatatatatgtatttttaatatgcagcttgcttcttatttatgtgatgagaagagaataaatgtcacattattttagttgaagaagttcgtcaacattttgtcttttaaatttaattcacctataagtttgtatcgtcttcaaccctgtgtttaaacacataacattctttaatagacacctaacaatttacaaacacctcatgctcctccatgtggcctggggagtgcacgatgatgctggccagcactaagttcttccacctatgaactttgaattctgcctttgagctttcataaatgaagaaagctatccagcaaagcagatgttgagcaactcttcatgtctgcctactctcacaggtggggacagcacttcctggaataacgttgctttggatttaacaacagttgggcaaaggaggtcggtatacagatacaggacaagaagagtggtgtcaaagggaggctaaatcattggttctggcttcatctaaggaattcttatgagaaatcgagggagagactgtcctgggaagtctgatgaaacatgtaagttaataggctgcaagaatcatttctatctggtgtctttctttccttacatttatttctgctccttgactgttcacaggtgacttgaaatcagattgccctatcctttttgaaaagggaagcttgttttcaatcctctgagtagtttgtaatggtgtgagggcagggaggtagtacaatctatcactttccaactttttacttttttaatttttaaaataaaaaaattgtttttgagacagaatctcactctgtcacccaggctggagtgcagtggcacaatctcaggtcactgcaacctctgcctcctgggtccaagtgatcctcctgcctcagccttccgagtagctgggactacaggcgtccgccaccatgcccagctaacttttaaattttcagtagagacgaggtttcaccatattggccaggctggtttcaaaatcctgacctcaggtgatccacccaccttagccccccaaagtgctgggattacaggtgtgagccactgcacttggcctaccactttccaatttaatgatcatcagatgggataagcaatattggagagttttaactaaaacaagaaggtactgctgggtcccatagaatgtggaaaattccattagttggtgttttctggttgtgctgggggccacactaacatggatgggtatgacatgttacttatgttagagataaatgcagaaaggtaaagaagcatgaccagttccaggcccacacattgcctggcagtggtctgtgaatcggcagtggagcaatgagtcattatcacaatgtgctggctgagaggtacagggacatgtcagttacagaggcactgctgtggagagaggtcttccttgtgtttcagctgtgctgcctgtagagggagacactgctcctcaggtaaggatttagagtgtggcatcagccaactgtgaatatgtcaagtgggccctaagtctctggcaaaaggaaaagggagaaagataggttttcaagcagctctagcaaggagtctgtgccgcatgtcccagatcaaaactacttatctttcctcctccttcttgtccatttgttttgttccattggttgacaatgacccttcagtttggcaggttcttggcctcactcactgacctaacagacttactaagtgtctgtaataagcacctaatgacgcaggtgtatttcattaagattcttcttcttcttcttttttttttttttttaaattcttcacagaaaggtcatttctatctggcaaagaacagaagagctttgtttttaggtcatgttaaccttcctcatatttgaaagaaaggttcatccctttgccgtgttttgattttgaggatgagtctgctctgtccattttgggccattactgcagagctcagctgcccaacaactggacttatctaggtcacaggggagaacatagatgtatgtaaataaaacacgtaactggtcaatattcatgttaatagcttcaatcctagtgtgaagacatgtgtatttgactcatgggagagaaccttttatgcttactttacacaaagtaaaaactaaaatgatctgttgatttactaataaaatcaggcccagattcaggttggccaagaagctagacactccataaagagaaaggtgcctaaactttaaaacttgaacttctagtcttctcctagtcttctctattgccagcctttgaaggcaagggattgacattgataagggcgctgatactatacattatggttagtgggttaggctgttggattaatgggattaacctggctactggctgatggtggcccagatgcagaagtaagagtagaaatttcaagagagaaatcacaaaacttgtcaaacttccataagatattgggtatcaccaagacagatgttaagtctcccagtacaacattggaggttggaaacatatcacaataggacaggacaatcactttcccagctaaagagtcacgagggcagagtgactcgcaggagagctagaaaggttcccagcaagataaggaggcagccttgatgtgggccccaatgccccaagcatgactaagggcattttgtaagaccaaatattgagtggtgtcacttcctctttattctataatcccatgagtttttgaatattcttaatcatggccggtggctgttgtaccctggtgcttggcaatgtccatccagggcaagggtacctttttctaatttgtgcaaaggttcaatatgggctagctgtgaccctacctatgacttcagagaatcagagaggagttatatgcccgtaatggggtcatatgattgttaaatttttttaaagatatgggggtctccctctgtggcccaggctggagtgtagcggcacaatcatggctcactgcagcctcaaactcttgggctcaagtgatcctcctgccttagcctcctgaatagctgggatataggggcatgccaccacacctggctaattcttaaattaattttttttttaatagagatagggtgttaccgttttgttcaggctggtccttgaactcctggcctcaagtggtcctccagtctcagccttccaaagcattaggattataggcatgagccaccatgatggctttgggtcaaatgttaaagggggaccagggcttgcctgaggtcattgatagttcatgagagagtcccacgaggatgagactcttgtgctgatggagttggagctctaaggcagaccttcacaccttgaactctaagtctcaagtgtgttgcaagtgtgccttgaggaagctggtcaaggtctggggaagccagagcctctgtactggtcacctctggctgggagtacccttgttcatttacctagtgtgtgtgcaatatgattatattctcagaatgccatgatgtgaacaaatttggggagcactgctataagatattactttacaaaggacttgggtttgatatcttgaaggaaatgtgtggtcttccttatacttggttatctggtttccagaaccagcacactaatattagaaaatgatgaagtgggaaaatgtttgctgaagaactttgagctacaactggattctaagccagaagtcatggaggaccctgcagtgaatgggcactggttgctgcaaagagtggctctggaacataggacagaatatgatctgtttaactcagagctaagtagctgtgatagtctccaaaacggaccagaccactcttactcctcccagtgctggcactgtgtgcctatgacatactctcagctactgatgacatggttatgctgattctctccttgagctgcctcccaagccctcctcctttttattttctttaatcatctctctctctccctctgtctctctctttattaagagccagggcttccatacatagttgtgcagtgcacaacccacacaactctgtgctaagagccttgatgctctgtgctgtctactgaacacaggtcaaacttgatagcctgtcatgtaagatcctggatgatgcagcttcagtctatctgagtcagtgaagaggctggcagaaaacaaatggtctcctcaaagagtttgactgaggagaatttacagactatttacaaagaggtgagtggggtgagaggaaccaatcagggatggtgaaacacttaggaattagccatagcaaagcggttaccactcctaaggctgaaaggacagaaaaaacaggggatgatactgaaccccggagcgaacttggagtcacagaagacaggagctataactatggagctaacactggcttagtagttaagaagcagggagggaaccggggataaatgcccatgtatctctgcccttgtactctgatctcaagccagagccccggtggccaaacccattggaacacagaggacaaaagggcatgcacgatgcagtctatagtggtcagtccctgcagggcagaaaagttggggaatgcctgtaattgggtcaattacagggagagtaactagcatattgccttccctccttccagccctctcatcctgtatgctgattccttttccgagcagtaccacagccttcgcacctctgtcattttgttcatgcttaggcctctgtatggaatgctctttcctgcaccctcctatatttatacatttgaaatcctactcatctttaaaatcccagcttagaggtgaccttcttaaagatttctttgatccctcaagtggaatcctctagggcagggacatctatggcttgcaaagcctaaaatatttactttttttttttttttttttgagacggagtctcgctctgtcacccgggctggagtgcagtggcacaggctcactgcaacctctgcctcccagtttcaagcaattctcctacctcagcctcccaagtagctgggactacagacacatgccaccacgcccagctaattttgtttgtatcttttagtagagacaaggtttcaccatgttgcccaggctggtggcaaactcctgaactcaggcaatccaccccgctaggcctcccaaagtcctgggattacaggtgtgagccaccgtgccaggccaaaatatttactctttagccctttacagaaaatatttgacagtccctgctctaaacttgtgctattcactatggttgccatgagctatgtgtggctatggcacatttgaaatgtgggtagtgagactgagaaactgagttttcaattttacttcatttttatgaattgaatttcaagtttaaaaaaacaacactcaattcagttatgaaaaacttttaagtctgtttagagcaatttgggtttgcaagtcttttttttttcaagtgtacattttacaaactttgaatgtggctacggtatttctgaagaaaatttagtttccaaattgccatgtgttttaagtgtatactgaattttcaagactgagctagaagaaaagagaatgtaaaatatctcattaataattttcatattgattttgggtcaaaatgatattataatagtgggttaaagtatattattaaaatgactttcacttttttcttttaaccttaatttttttaaattcttatagattcaggaggtacatgtgcagttttgttacatggctatattgtataatggtgaggtttgcacttctagtctacccgtcacctgaatactgaacattgtacccaataggtaatttttgacctttgccccctccgactctccccagtatctattatttcccactatatgtccatgtgtaccccttgtttagctcccacttataagtgagaacatgtaatatttgactttctgtttctgagttatttcacttaggatggtggcctccggctccatccatattgctgcaaaagacctgcttttattcttttttagggcagcatagtattccatgatgcatgtataccatattttctttctccaatcatttgttgatggacagttagggtgattccatgcctttgctattgtgaacagtgctgtgataaacacagagtgcaggcatctttttgatagaatgatttctattcctttgagtaggtactcagtgggattggtgggtcaaatggtagttctacttttagttctttgagacatctccatactttttctgtattcccaccaacaatgtataagcgtttgtttttctccacatccttggcaacatcagctgttttttgattttttaattaatagccattatgactggtgtgagatggtatctcattgtggctttaatttgcatttctctgatgattagtgatgttgaacatttttcatgtttgttggttgcttgtatgtctgaagaaatgtctgttcattgtttatgtcctttgcccacttttcttttcttttcttttttttttttttgagacagcgtcttcctttgttgcccaggttggagtgcagtggtgtgatcttggctcactgcaatctccacctcctaggttctaagagattctcctgcctcagcctccggagcagctgggattacagatgtgcaccatcacgcccggctaattttgtatttttagtagagacggggtttcaccatattggcgaggctggtcttgaactcccgacctcaggtgatccacctgcctcggtctcccaaagtgctgggattacaggcgtgagccaccgtctctggccatcctttgcccacttttaaatggagttatttgtttttttcttgttgaactgagccaaacaaaagctcagttcaggcaggccatggttgcttatgctggtaattccagcactttgagaggctgctgcggacggatcgcttgagtcgaggagttctgagaccagcctgggcaacatggcgaaaccccattctacaaaaaagtacaaaaaattagctgggcatgatggtgctctcctgtagtcccagctactcaggaggttgaggtgggaggattgcttaaacttgggaggtggaggttgcggtgggtgacagaatgagtccttgtctcaaaaaaaaaaaaaacaaaaacaaaaaacaaaaagaaaaaaaaatgaaaaagcttaatttaacagtttttcttgcatgtgaatgacctctgagcttttaaatggaaagttgacactgagttttggtgaatggcaggggtttttggtttgtaatacaagtgctttttttcttattaagtttttccttgtaggttctgggtatcagtcctttgttggatgcatagtttgcaaatattttctccctttctgtagactgtttactctgttgattatttcttttgttgtgcagaagctttttagtttaattaagtttcatttttctgtttttgttacgtcttagtcatgaattctttgcgtaggccaatatctagaagagtttttcttaggtgttcttctaggatttttatggtttcaggttttatgtttaagtctttaatccttcttgagttaatttttttttatagggtgagagataggggccaagtttcattcttccacatgtggttatccaatttttcctgcaccatttattgaaaagagagtcctctgcccagtgtaacttcttgttagcattattgaagataagttggattgttggtatgtggcttcatttctggattctctattttgttccattgatctatgtgtctatgtatgtaccagtactatgctgttttggttataatagccttgcagtgtaatttgaagtcaggtagtgtgatgcctccagctttgttctttttgcttaggatagatttctatggagtaacactgctctgtagtaacattcagaaactgtaataatttttatactgtggtgacacatatatcttcctctctagattcaaagtttttttaaagtctgggacacagttaaaaaaattctgatgtatatgctctgcttgcagaaggtactcaataaatgaatacaagtcaaacaaatgctcaattcaaacactttcttgcatgtagatgactagttctctgggcttttaaatgggaagttgagactgagttttactgaattgcaggagtttttagcttgtaaccacaagtgcttccttactgtaagatagatgactcaatgaataggcttcttacagagaaaatgatggacagtggactcttttttaatgatcggtaagaatttatataaggccatgtctaatttttaactacagaggatgactatatcataaaacagaaaattgtcaaatgttcatgctctaccaggggtaagctattatatttgagaggacacattttttttaaaatttcaatagtttttggggaacaggtagtgtttggttgcatggaaaagttgtttagtggtgatttcatgggaaagttgtttagtgatgatttctgagatctttgtgtacccgtcactcaagcagtgtacactgtacctggtgtgtactctttaatccctcacccacctcccaacccttccccctgagtccccaaagttcattatatcattattatgcctttcatcctcatagcttagctcccacttataagtgagaacatatgatgtttggtttgggggaggatacatttttaagggctcagcatcaattaaacatttcatagacatgaaaaataatatatcagaaattcaattcaaatccagcacgtatttattgagcacatactatgtgccagggattgttctaggctcttgggatgcaccagtgaatataactgacaaaaatgtctgcctttgtggagcttatgtcccattatgtttattataacatgataaataaactagtatattaggaagtggtaagtacagtagaaaaaaagaggaaaatagagcagggtgagaggaccaggaatacagcatggaacaagtaacacatttaagttagggtggtcaggacaggcctcactaaaaggtgccatttgaataaagccctgatgggtgtgagggatttctccatacagctatccaggagaaaagcattccagacagtgatgagccaatgtcatgggtctggttggggagttcataggtatgaccaaagaagagcaggaaggcagagcagcaagaagaagtcagcagggagaagacgtgtaggagattaaaaaaaaaaaagagaggcaatttggaccagatcatacgggtcttgtttaaagactttggctcttttttttgagacagagtcttgctttgtcactcaggctggagtgcagtcgcatgatctcggctcactgcaaccttcacctcccgtgttcaagagattcccctgcctcagcctcctgagtagctgggactacaggtgcccaccaccgtgcccagttaatttttgtatttttagtagagatggggttttgccatgttggccaggctggtgtcgatctcctgacctcaagtgatctgcctgccttgacctcccaaagtgctgggataacaggcgtgagccaccatgcccagccaactttgacttttgatatgagagaactggagagcagaggaatgacctgatctgacttaagttttaagagaaccactgtaactgatatgttgagaatacactagaggttggcaaactattctgtaaagggccagagcatttatgatctgtgagctatacagtttctgtcacaactattcaatgattatagcacaaaagtagccatgcataatatgtaaatgaatgagcgtggttgtgttccattaaaactttatttatgagcactgaaattttatataattgtcatgtccctcaaaagattttttattttgattttttccaactggtttaaaaatataaaatcattcttagcttttaggatgtacaaaagcaagcagtgaacccaatttggccactggggagtagtttgtcaaccccttgaatagattgtagggggacaggagaacaatggagactatttagtaatccaaaggaaagagatggtggtaatccagacgaggataatggcagtgcttgtgtaagaaggggccatattctaaatatatattgaaggttaagccaaaaagatttgttggtggtttggatgtggagtgtgagagaaagagaagaaacaaggaagacttcaagattttttgtctgagcactttgaaggatgtattgccattgaccaagatggagaaggcagtagacgaagtgggttttggagtagaagattaggagtttggttttggacatgttaattttgagattgctattagatattaaagtggagctggtgaggaggcagatggatatataagcctagagtttggagaaaggtctggtctggagataagacatttgggaagcattgcatgtagatagcattcaaagtcttgtggttgcatgagatcacctagggaataagtgttgacagaaaaggcaaaagagagccaaggactcaatcccagagtattttaggttgatgcaaagagaagaaagcagcaagggccgttgaggagtggtcagtgaggtaactagaaagccaggatactgtggtgtcctcaaagccaagggatgaaaggatgtcaatgaggagggagtgaacaattggatcaagtattgctgataagtaagataagacctgaaaactgaccattagatttagccatatggattcacagatgcccttaacgagatcactttccatgagctgtgggattgaaaaactagttagagttggtttaacagagaacgggaaaagtgagtaaagataaccccatttttttttctagttttgttgcaaaggtgccaaagaaataatgggggaagagtgaaatcaagcaagattatttttttctaaacatgagaaaaacgtttgtatgctgattaggggtaccaataaaaaagaagaatccaaatacaggaactttattattttataataactcaaagaggaaaatctatactccatttactaggaaatgggcatcaatgtctacaataatcacaccaggtatattatatacacataacataaaaatactccaatccgttagactgactagctataaaaagtttttaatgtttaatttacagttttacttgccaccttagaatttacaagacctttttgatgatggattgtatgacccatttctgttaaagaagctgacctgataacttgattttccttttcattaaacttccccctaacagaggcattcagtatcattttactgaccatagaactatcatcattagtcttacttatcaataattttattagcaacaaaagctgacaatgattcttgccttaaaaaatatttctgtatgtatcgctaataccagtttctccatttcatcctccttccttcttagtttatttagagcaagcacaatcagaggaaatataggttacaaggaaacaaatcaatggtggtttatttatttatttttttagagacagggtcttgctttgttgcccaggctggagtgcagtggcgccatcttggctcactgcaatctctgcctccccttctgcctcagcctccttagtggttgggactacaggtaagtgccactacacctggctttttatttttattttttgtagaaatggggttttgccatgtcgcttaggctggtttcaaactcctggactcaagcgatctgcccgccgcagccttctaaagtgctgggattacaggtaggagccaccacacccagtcaaatcagtggctgataagtcattcaacttacaactttcaatttaaccttttgttggcagctctcagaggactttgtaattgaaaagacagaatcatagaaacagtaatcaggttctcagcagacttttcaaaatacgtttccaaacatccctgtggaattaagaccaacattagacaatctactgattttccagcctgctggtgtctctctgtgctcagattttgaataaatgaatgacttcagctttgtttttcaattaattgttatttaatttaagacatcttaagagatgtacataaaagtactttgtataagacaaaggtgaagattgccttaggcatatttgagaaggtttgttcaataaaaacttaagaaaataagtgaattagatgtttctggacatttctttcaaccgctgattttgttgtggttgttgttaacttaccaaaaagttatagaacctttctctagaactcgtggataatactaagcaattgctctaagagttagctatgtaagtatgaaattcttagcccctacatttccttttcagctgactgggacagatgaaaagcagcaccagccacaggtttctttctcattctgtgtaattaccatctctaatcctgaatcactcaaactttcctaccactatactctgcacctattctctgtttcatatcctatctatgatgatgattgttaaaaagtttctcaatatatcctagatgcagcatcaaccaccactggcccttttcccccttttgatgttggcaatgggggcatagaaactacagtacactttttaggagttggacagggacagaatggaataggttggacaaagtatattgggattgggataagatggaggggttggtgtaggttgaagttcttccagatgtaatacagggtgtggctgcagggtgagtgggtttgaagagaatttatgggtaccaaagaggctggatgggcaaatagttaaagaagcaagagaaaatactttaactttctccaagtattgctcccatgagtggctcaactgtactaattaaaatgaaatcaagtagcaacttggatgtctggaaagacctctgagtgccaaaggtgtgtgctcactctttccttttcacagagttggcctgcagatgatgaaaacaggtatgaggtcaggcatctcctctttcatccagaccatggcattgattgctcagggaatctcatttctccaacatttgctgaagctattaatacttcccctagtttccttcctgtcagagtgtttgaagaacactttgagaaatcagaaaaatatttgagagcaaatagtgtgaaatggttctctttgttgttaataacaaatcataggagtcccatattcccacagatctacaaatcatgtgtcaatatctagtttgtaagtgtctccatttgtcctctatcattccagaagtctttttcatatgatgtcaggggaactgaaatggaatgtaataaaatttaaacctgggatttgctgaaaagaaacagaggtggtattagtcttgtttttctcaaacttttacctcatttctttaatatagctcttgctgagcaacttgaaaattctcctagagaattgaggcttggattttttgcagctgcccttgaggtcaatctttaaattgcagtgtctatggtgaaagagaaaattgagtcacaggaaggaataagttatgaagagatttttgtcaaaatatttcccttccaataggcagatagatagtgctactcttgacagcaaatttctttttgttttttattatttttatttttattctgatggagtctcactctgtcacccaggctagagtgcagttgcatgatcttggctcactggaacttctgcctcccaggttcaagctattcttgtgcctcagcctcctgagtaggtggaattataggcatgtgctaccatgcttggttaattttttgtatttttagtagagacgggggttttaccatgttggccaggctggtctcgaactcctgacctcaagtgatctgtctgcctcagcctcccaaagtactgggattacaggcgtgagccactgcgcccagccttgacagcaaatttcctaatgactagaattctgtgtttaaacctcattattgtaaataatgctgcaatgaacataggagtgcagatacacctttgacatgctgatatcaagtccttccaatatattccagaaatgggattactggatcatatggtagttttgtttttagttttttgaggaaactccatactattttccataatgactgtactgatttagattcctaccaacagtgtactagggttcctttttctctgtatcctcaccaacacttgctatctttaatctttacacaatgaaatactgttcaggcttaaaaaagagcaaaatcctgtcatttgagacaacagggtacatctagaagacattatgctaagtgaaataagccaggaacagaaagacaaatagtacatgatctcacttacatgtggaatctgaaaaaacttgaattgatacaggtagagactagaatgatggttaccagaggctagggggaaaagggcggagggagcgggaatggggagttactagtcaaagggtacaaagtttcagctaggcaggagaaataagttttgctatctcttgcacagcagggtaactatagtcaatgataaagcattgtatatttcaaaataagtaagagagtaaatttcaaatgtatcaacacaaaaaatgtcaaataagtgaagtgatgaatatgtttattagcttgatttaaccacttcccatgtatacatacatcaaaacatcacattgtactgtgtaaattgaatatgatttttccaattaaaataatataaaatttaaaaaatcccattacaggctgggcggggtggctcatgcctgtaatccagcattttggtaggctgaggcaggcagatcatttgaacccggggcaacatggtgaaaccctgtctctacaaaaataagccaggagtggtgctgtgcacctgtattcccagacacttgggaggctgaggtgaggggatcgcttgagccaggaaagttgaggctgcagtgagcagagatggcaccactgcactccagcctgggccacagagtgagactctgtctcaaaaaataaataaataaaatagagaataaaaatcccattatgatgaattattaatacatcattacatggtttccataccatggagctatttctatagtgcttcatgactgaaatcccctcagaattcattacaaaaaaccatgttattgttttttaagactaacaggcataggactgatatatatatatatatatagacttttaattgtatgttgttaaataatgatggctattaccttcttaagccctctccatctaaaatacttcaacaaatgaaacagaatacttcaaaatatttctaaatttccaggagaaatttcaaaattatactaaatgattgagggtgacagatttgaagttgcttatacaaataactttttctctattctgtttaaagatttttacttactaaattcatatgaagaacaacaattagttgcttaattttccttatgcaacttatagctatgcatttatgggaaacaagtattttgacaaaatatgattatgctgaccaatggaataaattatacaggggtttcaccttcttagtgttcagcttaccagatgttgctacaagataagcactttaaaactcactggcttaagcgcaattcaaaattgcaaaattgtggaaccaaaccaaaagcccatcaatcaactagtgaataaagaaactggtacatatatatgatggaatactacacagccataaaaaggaatgaattaacagcacttgcagtaagctggatgaaattggaggctattattctaaatgatgtgactcaggaatggaaaatcaaacatcatatgttctcactgatacgtgggagccgagctgtgaggacgcagaggcataagagtgatacaatggactttggggacttggagaagaagagtaggaggggggcgagggaaaaaagactacaaatatggtgcagtgtatactgcttgggtggtggctgcaccaaaatttcacaaatcaccactaaagaacttattcatgtaaccagataccacctgtactccaataacttacagggaaaaaaccccaactcactggcttagatttatcacatcctaaaaaaatctaaatttcataatagctagattattattcatgtcacatcactgatatctgactcccctagtatagctctaaatacacaataactcaattagccattctgcgaatttctttaaatgccacatcttttattgttaattatttaaagcataatattattacgataatttccaatccaatatttttaaaaagtatgtacatatttaaaaatcagcagtacagaagagtaccagttgaaaagtttctacttgtattagtctgcttgggctgccataacaaaataccacagactgggtgacttaaacaacagaaatatattttcttacagttctggaagttagaagttcaagatcaatgtcctatgagggttgatttctggggagccttctcttcttgacttgtagacatctgccttcttgctgtgtgcatgggagtggggaggagggacagctcttctttctttttttaaaaaatttttattttcaattattatgggtacataacatatatatatatttatggggtacatgcgatgttttgatacaggcatgcaatgtgtaataatcacatcagggtaattggggtattcatcctcttaaggacgatagccctactggtttaaagccccacccttgtgataccatttaaccttaattgcttccttaaaggccctacctccaaatatagtcacattgggagttagggcttcagcatataaatttaggggagacataactcagtcctgatatcactcaatccctaagtccaaattccagagaaaaccacttcaagctattttctgattttagtcactgtaattgtataatatacttatgtacttgttttctgaacgataaatatttagacatcatatcttttggctgcatataatgaagattaggaaattacaagtgacctttgaacaatacgggtttgaactgcgtgggtctacttacaggcagatttttttctacctctgctacccctgagacagcaagaccaacccctcctcttcctcctcctcctcagcctgctcagtgtgaagacgatgaagacctttatggtgatccacttccacttaattaatagtaaatatattttctgtccttatgattttcttaataacattttcttttctctaactcgctttattgtaagaacatagtatgttatacatatacaaaatatgtgttaatcaactgtttacgttattggtaaggcttctagcgatcagtaggctattagtggctaagtttctgggggatgaaaggttatattcagatcttcaactccagtattttttttttttattctggaggcattgatgatgtcgctctgttgtcttctagtttatactgttattaatatcttttccaatgtctacttttctttcttgattctccctcaagcatttaaggtttgccttttacttttggtgttctgacattttataagtgctgttctgcccatgtgccttttcattcatcaccttttgcactaagtggacactatcaatctttaccagctttggaaaattttctccttctgtttccttgatgattatgccttctacgttttccttaggactcctcttggacagatgtttggcctggagacggatcctctgcatcttttaacttttgtcttatatttcacacctttgtttacttgttcaacatcccaagaaatttcctcactttaacttccactccttctggtaaagctcttgctttggcaatctcatttaaaattttccaaaactctttctaatttttgattactactattgttttaatagtaattttgattgtttttgggtctgacattctctccaatttctctgaagttattaagtgaaattaaacaacaatattctgtttatgaatgatctattttctctggagaaatgttcttttgtacattctggccttgtgtgtgtgtgtgtgtctctgtgtctgtgtgctattgatgtgcagtttatttctctcaaatgtctggcaattattgtgtcttctttatatttttgagtgaagaatgagaatagctaatgtcagcagattgtatagatcattttccccaagatgtttctccctgacttcaggtgggggtggtggggggtgctgatggtaacgcctcaatgatcaggcttcacttatgtgtgagggcaggaagtgggccagtgggaggagttccctgtttacaggaatcattcactttctttgagatattaattgcagcaaacactgcatatgtcagttattctatgaatggagtgatggcagattggagggtccaagtgacacagactttcaattaattgccctaattaaccctcagtcctgtaaccttcaggcttggcaggctcactgggactctgcagggaagtatattcttctgtagctgcagccttatcctgtcagtgttctaggctgtaacctcctgtacagttagttaccatcaactcaaggccatacaccttccatctttcagaaagctatcaacacgtttgctttgctggtggttctatttctcctgttcaccatgcagttttggcttggtctcattttaaatttcttccctgtcatgtcagtgggatttgaaagaaagtcagtctaccacttggagctggaacttttatagcttttaaaacagaatgcagtgatgccaacaagtttctctggcaccctttaggtactcagaatgaatgagaatcactcaattatgttatgaaacagttttctcctaaagtaggagcatttgttctcaaacttctattgttttaaaaaagtattgtggttatagttttcttctttttgccctgacttttactttattgccactctcatggtgctgccctgtaagaccctctcctcattggctgcttctttgatgcagtagattatccttaaagcaagagtcaataaactttgggggtgttttaagagacagccttttgagaaacatgcatgagctttagagaatgaattgtgtgacctccactgcgactagtctgtggccatttatcctcaatgatttgggtttatcttcagataattgaaaggtgctagataacatgagctctgaataataataaggcctctgaggccttagaggtttattgtcttcattagcacactatttaaatttctagtgtcaataccaatcatttgcttgatatatttggttttattgttttttctcttagtgatccctgtcaattaatcataattcagttcaccaggagtaagtttttccacataaagaccacttttgatcaagacacaatgttatatttaagttattaattgacagtcaacaacttatttattaatatggattcattagcaaatgtgccaattagttttcttgtcttcagttttaacacatacaatagtaaccccgaaagaaactcacagattaacaaaaaagaacaacactctaggacttggcacgattattccataggaagaaaatttatttcatgttgtgagtgcaaattttagtaacaattctgttgaagtcacttttctaggactctgtttccaaagcaattagttcagctattcaagatgaaacacattatttatcaagatgtgatattttgaaatgtcacaggagagaaacacatgacaaaaggcaacacatttgtttaatttcattagttacaagcgaacttctaggtaagtcatgattttcgatgtttataatatttctattaagatgtgcaggtctcaatgatagtgatgagtgggtatggctgtggagagattccaggtgagtccagcagggaccatctgtggggacccattaacgacacttcacaatcttaaaacaacaaagagcttttatttcatggtgtggtttatgagcattcagaagtaatgtcatctctgcttggagacttttctagcaggacattagggggctatcatcacaggtaacctggagagtacatctgtagataaagatcctgactattttaagtaaagaagaattattggggaaaagaagctttatgtccagtgatcaacagggctggaaagagctggcagtttcagaaaagaagaaacctctcttgacagctttagtatcataccgtggactggaaatggcaaaaatcatccctaaagacaagcgaagtgttttgaagtgactcttcatagtgaagtagcaactctaaatagccaaaatttgcaaccatcgtttactcttttatataaacacgaatctgtttttggcctgatataacagctgggtagatctagtaattaaatgaatgattcagatccaggcgagtatgtttacttaattgaatttttggctcagacatcataatcaaaagtgaaacaaaggaaaaatttcctgggtcatgtgtctaggcttcaaggactaggagtcagcagccctacaaaataggaaaaacagattctacttacttagtgctcttctttctctttatcttagaaatatatatttgagggaaagggatgtactagagttttaaaattggaagaagctattggactccttcatttctacagatttaagtcccatagttaattagtgtccagcctgttttattaatcaacaggggattgagtgtgctctgcccataattcccacttattgctactcagaaagacttcctagagttcacatcttttatgctatgaggctggccaagaagagcaattcttagtttgctaggccacataagctgaaatcttgccagtttttccaggcaacacataatagcttggtcacatcaggtggattcttgtgaagagatgattaataggttgagttaaaaaacaaaacaaagcaaaacaaaacttaaagctaattcttaccctccttcatgtctcataatagctgtttcttgtatgacagctagctgtgtttggcttttcagttttaaggaaatcaagttctctttgtatcagggaacatctagttgaactgagccaacgtgggactgattttatcttgtggtcaccaaccaaattaatagcattttccatttgctgaatctttagtatgaaatgttatacaaaactgagaagctctatattgacatagctcagttaatatttactgaacatcctacacaatgacatctctggacttggcatcaagaaagtcttctagatagtgtagattattttgatttcacctggcattcaaatatgctggtagcctaacttccttcttgggggcaatgattaggttaatactaatcactctccagagataaactcttgccccatgaaacattgaaacatcgcctgcacaagagtgagggcagctatgtgttgggggtgtcatgggattggaatgcatattcaagaaactattattttgtaagttcccctaccattgtgagtagtgtagtgttaacttacaaaaccgtttgcatatactcttctgagatttggccttgcttctttggggttagatgggagttttcaatcagttcatagacatcttccatgttgtggagaccctgcctcatctcgtgggtaaccttttgaacctgaatatcagtgctgttctttggaggaaccctctgcccccggtatgcctgagcctggcgtttacagatgccaaacttgctgagtaggatgaacacatccctctggaaggccttggtgaaaatagcatagaggaatggattggcacaggagttaagtggatagaagagtaccagcaagattttggagttgctaacagtgatgagaggcttgttcagaattgctgacagagcatagaatgagattggggccatgcatatgaagtcggtgaagatcaacacagccatcctcttggcaattttggtatctttgtcccctgggttgtactgcggatttcggactgtgatgtagatcttcacataacagcagcagacgatgacgaaggcaactatgttgagcgtcagaacaaaaacaatatatgccagagcaagaggggtctcggtgtccatgggcaggcagatactgactttggcatagctacttattcccaccaaaggaagcagggcgagaaggaagcagcaaacccagcccccaaccatgatggcacatgcgtgcctgaggcggatcttccggtccaggcgcatggcgaaggtgatggcataccagcgctccagggtgatgaccgtcagcgtatacaccgataactcgcttgcaaagacagtgaagaaaccagccgtgttgcacccagggcctgtctgccagtcgatggcatggttgtagtactcagagtgagtgtagaggtctacagaggcgatgaggagcaggtacatccccatgcagaaatccgcaaaggccaggttgcacatgagaaagcgggggacgttcagtttgtagtggctggtgaggagaataagcaggacaaagacattgcccaggagagccagcagactaacgaaccacaccacaattctcaggaacttgtagcccattatgtcttcacacgggttgaactcatcggacttgggggtacacaccatgtcttcactgtccccacatatggtgtagtcataatggctgtcaaaagcttgtagagtctcttcctgggggtttttgagctcctggccaaaaccaatgatctcatcctcttgttcttcaaagaagacgtaataatgagcgttgttatgagtatcctggaacttggacttttccttgtacccaacaatgctgtcacccagattctcttcatattcctggtggagggggctattcaaggcattcacagattttctctggcgcaagctctgcatactgctctcattacacatcaaggactcaaggattctgcaaggcaacagaaaagagtcagtgccaggctgggcgcagtggctcatgactgtaatcccagcactttgggaggccaaggcaggtggattgcttgagcctaggagtttgagaccagcctgggcaacatggtgaaatcccatctctataaaaaatgcaaacattggctgggcatggtggtatgtgcctatggtcgtagctactcgggaggctgaggtgggaaaatcacctgagcctggggaggtcaaagctgcagtgaggcgagatcaggccactatactctagcctggatgacagagtgagaccctgtctcaaaaaaaaaaaaaaaaaaaagaatgcttgtttaaaacccacgaatggttcccacatttatgaaaatgtgcaaactacttactatgatgtacataattctataaggttctacaggatccaggcaggcctgtttctgtgacatcattcctatgacctcccctcccctactgtgctccagtggcattggtcttatttctcttctgcaaccacttcaagaacagtgattaaaaaaaaaaaagtggccaagtgtgctggctcacacctgtagtgactcaatcccagcactttgggaggccaaggcaggcacatcacttgaggtcaggagcttgaaccagcctggccaacatggtgaaaccccatctctactgaaaatccaaaaattagccaggcgtagtggcacgtgcctgtaattccagctacttgggaggctgaggcaggagaatcgcttaaacctgggaggtggaggttgcagtgagtcaagattgcgccactgcattccaggctgagtggcgacagagtgagactctgtttaaaaaaaaaatgtggatgctggagccagtcgccttggtgggaacctggctcaattattgactagcttgggtaggcccatgaagtttggttaactcatttgtaacatgggacaatgggagtgactatttcatatagggttattaaaggattcaatgaatttatctttttaaggctcttacaatagcacctgcagctttgtgagtgccatatggtggttattgttattattattcctattcaaagctctaaaaccctatgttcccattgcctgaaaaacccatggctgcctctactcatcattatttagtttcaaactgaatattttaaaaataaaacatttatgtatttttagtagatacagggtttcaccatgttggccaggctgggcttgaactcttgacctcaagtgatccgcccacctctgcctcccaaagtgctaggattacagaagtgagccactgcccccggccagcctgtttattttctgacttcctccattagacagtaagcaaaatacaagagggaattcttgtctgttctatttacaacagccaggcacatagaaggtgctcagtaaatatctgtttaacaaatgaacaaatggacactaccatacaggcatgcttgtggaaataagatttagttttttccttgctcaccagactcacaacaaaagggattctttaacttgcctcagctgctgagcagagtttgagtgatctcttgggttctgcttaaaatgtccaatggacttgctcttctcaactggaggctagggaaaaatctagaccctgcccctgaggtccacttaagcctcccacccagcccttgtccagtccttctcaatgccgcatggcatcagtgtagagtccactatcaccatcctctaccccactcctggctttttgcagctatgatgcccatattggccttctttgtgtgtgtgtgtgcatgtgcctgtgtgtgatggaatctcagaatcttgctttgttgcccaggctggagtgcactggcacgatctcggctcactgcaacctccgcctaccgggttcaagcaattcttctgcctcagcctctccagtagctgggattacaggaacccaccaccacatctggctaattttgttttttgtatttttagtacagacggggtttcaccatgttggcctggccggtctcgaactcctgacctcagatgatctggccatctcagcctcccaaagtgctgggattacaggcgtgagccactgtgcccggccaccatattggccttctttgtatggctgttttagcttctgccctcacacctagatctgatattttcctgactgcaattatgtgtgtagtaagtcaatcactaaatacatagaagctgaggaggactgaatagagatgatgaaggtggattaggagaacaggagattgtacaagacacaatgggggaaataatgcagagtaaaagcaaaaaagtaaaagaatcagagaaagcctggagagaaaatgaaggcaattcctccttcgcaggctcataagcagcctgatgtgcacatactgtatatcatagttaatattaatgaagatcttataatattccaggccattccattccagtgttttccattcagtttctcatttaatcttctcaaaactgctatgaatgttagtattaggatctccattcccaaagactcagagtggttaagtaactaggctgggataacacagcttgaaaaatggcagagctgcggtataaacccagctgactccaaagcctgcaggcatgtaaccagggagctatgacatttgcaaggcccaaaccaatcaggtaacccaactgtttgtgttgtttataagtctgttctcatggttgtggtgtctggggtctaatatgtgttgcagtatctaattctgaattgtacctggaaaccggacatcatatctacataacctctacaagattctatgagatctggttgtgtttctctctcctgtgccatctgtcacctcctctgctctaccgctatccagcagcaattgccttatttctcagctgcacccactttgggtccgcagggtcactgtgtcccatggatttcctgtttcatatggatgcttccaatttcctctccacctggttttcaaaccaggaagcatcttccccaaaaccaagaaatgaattccacttccaccaaggtcttttgtcacttatgccgggtccctgccacttaccctctgattttcttctgattcttaaaagcacagcagtggcttgggtaagaaaggtcagcccgtgtgaggtgaaggaaactcaaggaaagtggaagtttcttaagagtccaggtgtttcttgctatcagttccttcaggtgctccaggcctttggatggaagggcagtgacactggtttgagacacgtccctgggaggcagagaacagaaaaatgcagagaggcagtgagcagccagggccttctcagccttggccagaaactcaaacaggcctgaggttaattgggagatgatatgctcctttcttctactgagtacataagctgagcttctggtctaaggagggatggatattaggcttctaagcctgtgttataggaactccttggaattccagtatccagtagtacaaatgctatttccacagtcattttattctatccatcacaatacatgcaaactcttggaatcagagagagatgtcaattttactctgcaacatgccaccatgtgactatgaaagggtctcaagaggcaagagaaatgaagtagaacagagacgaaggggactactttgctatcagctgctgtggggactagagtttggggactgataaactgctcactgatatgaatcaacatcagtatcatgaaaatctgataatgatgcagacctcagagtcataaccagttacattgggaattcatgactgacaacatttccccccatcccccgccactccagtgtctttagaagactgtaaattgattcttggaaagaaaactcaagtgttgatattaacaatgtgaaatcagattcaaatcacttctgagaacaatggggtgaggggggtggtggtcaggctgggaacatgtagacatcagtgttagttactaaaatagaatgaattcgtggcattagtgtggcattctctgctcttttctgaatcccagagagtccaggttccatgtcttgctccatcatttttattggcaccattaatagcttgaataaggccatgaatatttaacctaatatccctcctattttatattttgtcaattaaaatattcctcatagaagataattccatttaaaatatttaatataattaatagtatccaattagctagtgaattccattattttccatttcctccccccacatcgttgtaattggacttagctggggtttacattctcaaggttcaaggccgtcagaacttaaagctcatgtattaaccccattctcaccacaggactgttactcttgtgaggaaagggttggtgcagttgctattttgttttgtatttaattaaaaaaatatataatctagcattttccaaactggtctgctggtaagaattacccttggtgctgctgggtgcggtagctcacgcctgtaatcccagcactttggtaggctgaggcgggcggatcacgaggtcaggagttcaagaccagcatggccaacatagtgaaaccccatctctactaaaaacacaaaaattagccgggtatggtggcacgtgcctgtagtcccagctactcaggaggctgaggcgggagaatcacttcaacctgggaggcggaagttgcagtgagctgagaccacgccattgtactccagcctgggtgacaaagtgagactctgtctcaaaaaaaaaaaaaaaaaaaaattacccttggcgcttgttcctgtattattcccaggtgatttttaacattagacatttataaactggcataaataaacacctttgcggttagtgagagagtggagggacttttgagccagacttaagcacagttgtgaagaaaatgaatctgggtttgctctctggcctcatccgtcctttttgaggcatgtctttctcttttagccatgctgtcttcaaggtgtggccatctttcaattccagctttctggaagcatcttaggttgcctttcccagtgatgctttcacgtcagtgaaacgggagagcatctcatggctcatttccctgctttgttgtctgctagatacactgattgtgtgtgttcatctgaaagagttcatccaagtaatgtgtttgcattttaatacatatttcttgagaaaacatgttagtaattatttcagttactgcgtgacaaaacaccccaaaactaagtggcataaagcaacaatctttttattatgagcataggttttatggatcattaatttgaacagggaatggtggggataggttgtctctgttctgtgatgtctggggcgtcagctgggaagatctggagtctgggatgactcaatgcctgggggttgggattatctgcaatttccttcactggcatgtctggtgccagggctgaggtgactcaaagactgagctcagctgggactgttgctgtggctactccatgtggcttgaccttcccacattatgtcagccagattctaagagaactatcaaattcaagggcagaggacatacagtccacctcttaatgggaagagtgtcaaagaattcggtgccttcttttaaaactgccctaatgttctaagtgatggagacagcattgaggcagataatttggggaaaaactggcagtttatcactctgcaaatcagcatttctagtccagggatcactctggaccagcatcagaatcacctgtaatacagattgagacacattccagaccaaatgaattataatctctgtttgtggaggctgggaatctgcattatttaagatgctctccaggtgattcagaagctggtttcaattctcaaagcatttttatgaagcgggcagatactaaaattcagacaaagaaataagggatgttgtgtccaaaaagatacagtgaaccaagggtggagtcataagtatcatttgggtctggagttctcagcttcagtgtcccaggagctagtcttcactttcaggtctttggagtctttgaacacagatccaggtgcagtaagtctccatggactcattaggaatctgggagggaagattccaaagtttgtctgagtatatgtaatgacatatcccaggtggcctctaagttaggtcccactcgggctgaactgggagggtgcttgggcaggcaaggagaaagtagatgttgggaaatgtgggtgcttggcatatggtaggtgctcaataattgttaatttcctccttgtcccaatttgaagtttatctgagctgaagccaaaagcaatgaagttggcaaatacagctccagtccagacctcaacttgtatatccaactgcttatttgatatctccacctggatgcctcacaggcgtctccaacttaatagggcctttcaaaacttatcttttcatcctttgcccttagctcaacctgctcctcctctatttccccccaacatggtaattgacactctcatccacttgattgctcaaattagtaaccttgaggaatgttggatttcctcaagaccattgtcccatccacatttaatcttgcaaaacacctatgattctgaactccaaaggaatctcaaatccacgtatttgcatctccagtgtaagctttctagtccaagctaacattatctcttactgaaatatctttcctgtccacttttattctttttcaatccattcctcacatagtagccagagtaatcataacatatgaattgagtaatgtcactttcctgcctaaaggcctacagtgacttctcaacgtaccatgaataacatccacgcttcctaccatgccctttaaggtcttgcagatctagcactggactacctctgtagtctcatctcagagctctaaggccacttacagacaaaattagaatctattatacttgaagacatcttaatcctcacttgtcatcgttctaagtatccattaggcatgctgcaccttaagtgttcctgtgcagtccacccacactatctctgcactttcagggtcaagcagggggaacaactgccttttttcttttttgatttaaccacccttgcagtgatctgcagttttaatcagacagtctggttgctatcagacagaaaggtaggagctcctctgtacttctctatggatctagcactgcctctccactcaaaatatctcaaatagaatgattcttgccttgaagcttactggaatgtctttatttcttgtcttccatctaccactttccagggcttgaagcttcgatgtccttgtggagtctctcttgcccttgccctacgttcatgccgtgaatatttacaacaacatgaaattgtgctaagaaccccccaccccaatcagatgtgagcccagctgttgcacatctacaatttcatggttctcattgctaccaccttagtttaggtctgaactacatttcacctgagttttgcaaaaactttgtgactggtctcagaaatcttccactattctgattttaggaacttaggaaagaatgttttttctaaaggacattaggaaagacttaggaaagaatgtcctttctaaaacacagatcttatattgctttccagcttgaaatccatgcctcctttaatatctacagaatgaagttcaagcttcttaggagactatttcccctctccccagtgggagtctctttctgaatcttgtgtcatcttttttcttgattttctctcctagagcacattttcaagtaatttcttaggctgtgtgaaggagatattttctgagtctttgcatgtctgaaaatgaccttatttttttctacccttatattcaattggtactttagctggctataaaatttaaggttgcaaatcgcctttcttcagaattttaaaggctttatcatattctagcacccattgatgcttttggtaagtatgaccccattcaaattcttattctttggtcattgacttgttattacttctggaagcttctcagaccttctctttatccctggtgtgacatttcatgaaggtgtaccttgataggaatctttttccatttattataatgggcactgggggaagacaggccccttcaatctgaagacctttgttcttcactgctaggaaattttcttgtattgtttatgggataacttattctcattttatctgttttgtctctggaattcttaataagaggaaaaggcacctcctggtccatcagacatatctccattttttcttggaattttctcctattacttttattaaattgcctggtaaaattccttgagtgcatcttccatctcttctactaaatttttaattttagcttcatgagagctgaaatactgcctgttctgtttattgccgtatttttggtacctagactggtgtttagccaacagaagactctaaacacatacttgttaaatacctgaatagattttttaagagcactttcttgtgttctgttccttttaaaaacagcgtatttggttgggtgcggtggctcacatctgtaatcgcagcactttgggaggctgaggcgggtggatcacctgaggttgggagtttgagaccagcctgaccaacatggagaaaccagtatctactaaaaattcaaaattagccgggcatggtggcacatgcctgtaatcctagctactcgggaggctgaggcaggagaaaatcgcttgaacccgggaagtggaggtcgtggtgagccgagattgcaccattgcactccagcctgggcaacaagagcgaaactccttctaaaaataaaaaataaaaaagaataaaaaataaaatgaaataaaaccagcatatttgagaaagcatacccctttgtttaggaacatgggttttaaattcacactatctggacttaaaccctggcttctgtgcttactatcagtcactgaaactttgtgtgctgcagtttccttgtcttgagtttgttgaacagtagctcttagtgtgttctcaataaatattagctattatttttattattattatcatgattgttatagtgatagggatgaaatgtgttctcagatttatctcaggtccttaattattgctttgttaaaggttcctttctcttttctgtgatttctttgatttctccaggctcatttccccgccatttgtgtatcttggttttgatcttccatgttaggagcattctttgactggagatctctggttgcacacattcgtatttaagagggtgcttttctgttggcagactttgctttagggtaattgtttagggagctggccattatgttggtagaccctaaagtgccagaatgtgaatgtcttttttgttttaggatttctcaacctcttcagcttagtggggaggtacttggctgttggaattttgcataaatagagtacaggattaatgcttccagatataaactttcagttaacccttctgttttcagtcccatgtcttactcttaccacatgccatacccatcacctctaagtcctattcctcccagagattttacagagcaaggcagcagtctctgactacgctccctctgagtactgtgagttttgccttccttcttttctatttttcttcattctgaattctgtagctcttcagaccatggatgggctctcacctgtcttctgtgaatgtatgcatagtaaaaattcttgtggatgtataaataggaaaaactcctttctcatctttttaaggggatctcaggagggagagaaaataaaatcttaggtgtaatgcttcatctttaacttttaatcactactgtatttagcacacagaactgtgcaagagcttggaacaaatacttgttgagtactgagccacatttgatagtctcccaattctggagttgtcggagaataaatctcagtctgaagagatcctcaaactcaacaagtcaggaatcattttaagttatttgaggctgtattttttcccactcacccaaagttttatttggttacttcaaatccaggatttttaaatagtgtgtaccttctttcctaaaataaacctgtcaacatgtagtatttttttttttttctgagtaagaagaatataaagagttgttatgggtgatgaaggggtctgaaatcacttgtggatgtagccatatggatagaaagctacaagctggagggcttccctctgttttgttgactctggcactctcttcaaagagctcatcaagcaatgggcattgaactccatgagaatttgtctctagcaagtatttactcgcaaatcagaatgcagctgagctgagtctggcagatggtttgaagtctaattgcctaggtcgtgggaataatctcgagttaagtgtctaatgaaagtaacaggacctgaatttggagagagtgagtcctgcagtattatatacagagaagaatatcatgagattttaatgatgccaggaaaaaaaagagctaactacgtttaatgtcataggaagagcaaattgaacctcaaaagcaattatgccctctagtatccccaaacattggaactatttttattttttgagagatattttgtcattgattattatttaagattaatttatgataaattcaattgcaaattaaagaagcactaattggcttgccagtgttccaacagcaattgcaagtgtcttttctgtttgcttgtcatgaaagtaggttttcccaaaggtcaatatgtggaagctgctccattataaatgcgcagttacatctgtaaattggtaaatgaaatgcatctaagagcagaaagattaatttactgtttaaaatacaatgtaattaatttattaatattgaattgaaaaataagttaaaggtttaaaaggtataaattcaagacagtgagcttgtctattaatatgtttaaataatttagaaatgcaatatgcatttatttagcaagtacagaatgtattgattgctgtctatgtctcaagtatagttctagaagctagggctataatagtaaactaaacaggcagaaattcctgctctcctcatgcttacattctagtggagaaaaaggtaattttttcttaaaaaagtgaagacatacagtatgttagatgataatgataagtactatggggaaaaggggaacagggaagagaaaaggcagagaccaggagtgggtcacaatgagagatgaggggacagtgtcagggaaggcctcattgaggagatagttgaggaggtgtctgaaggaggtgagggagacagccaagctgatatctggagcaaaagcattgcaggccaaaggaccagcagtgtaaagactgtgaggagtgcacctggtatatttgaggaagcaaggaggccagtgttgctggtgctgagacggtgagggcatagaacatgtgggagaagtcagcggacgtattgggagccagatcatgtgtggccttgtaggctgtcgaaagaacattacattttcatggaagtgagatcaaaaggctgcagaggaatggtataatctgacttatttaaaaaggatcatgctggctgctgctttgaaagttaccaaagtgagtaaggcgtggaaacagggagatcaaaaatagaaaggatggtgctttggactagggtggtagcagtggagatactgaaaatggttggagtttgtagatatttgaaaagtagagccattgggactttctgatggatgggatatggggtatgtgagaaagagaagggttgagaatgactccaagatttctagtctgcagctgggagaatgaagttgccatttcctgagatggggaaggctgcaggtgaggcaggtttggagggaatgatcagaaattcacttttgggcatgtcaagtttgagatgcctattagacatccagatggtgacggcagtcaagcagtgtttttttttttttttttttttggagacggagtctcgctctgtcgcccaggccggactgcggactgcagtggcgcaatctcggctcactgcaagctccgcttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccaagcagtgttttataagcgtggaatttgggagaattgtctggactggagatttctatttgggtatcataggcattaggtaaatccatacaagtggataagatcaccaaggaagtgaatgaagatatagataaaaagaatatcaaagatggaggcctggggcactccaacattaagagatcaggaagaagaagaagaagagctagaaaaacagagtaggaaggaacaatcagaggtatggagaaaaaccaagagagagtagtgatttggaagccaaaagaagaatacattccaaggaggatggagtcagcaactgagtcaaatgcctctgaaataagtactaattggccacttgatttagcaattgtggaagtcactgttgacctggtaaacggagttttagtggcatggtgggaagtgaaaacctgattggagtgagcataacagaaattgggatagttgctgcaaaaagacacagataaatagggcagtaggtggaagtagatttgaaggaagggatattttaaaattataaatatttcaatattttctaagaattaaggaatcttttaaaaataaataacatctaaaacaataactctttaaggccgtgtaatattcaatcatcagttttccaagaaaggcaaggtagttcttaccttgtttaagtcagatccaaatagacccagacatggcattcaactgatgtcttttaggtgtcttttaatccatattcacgaaacattgttttaagatggaagaaactacagcatgtttatacactgatgggaaataacttagtagggaggggaatacagatgattagggaagaagggagaggattgctgaagcaatgtccttgagtttttgagaggcgatgggatctagggccccggtgaaggggccagccttaaaaagtgacttaaaatacggaagagaggagaaaggatgtgggcatagacacaggaagatgggtagatgtggtagtgggacatgaggagttctctttggattgattttatgctcagtgaaatggaaatcaaggtgatcaagtggacatgagaatgagggagaggactagagaactgaagagaggggaggccataggacatggtcatccaacagactgggagagggaatggggaagtgggatgtgattgctgtgcagcaggtagagcctgcttggggtgaatgatttaaggtgaaatcacttgctatgttcagctgcaaaagcccaggcctgcagcaggtgggtggttagacctaaccaaggttgggcttggccagaagaggctgatgagacagagaggcaaggtagttagttggctgcgtatacaagtcagtgtttataatgacagaacatggcatttaagctgcataaggaaagagtgaggatatgagggaggtgagagacagtgaaatgttagtaacagactgtagatcctggcagaaccaaaaaattgaaggattaatgtattctaaggaaagagatagaaagagagcaggatgtttaagattaaggttatggaggctttgtagtcattggtcatgacaggtctagtgaagcctggaagtacaatgaagggcaggcttattgggggagtggagctcggaggtcaaggtataggaaagataatccatgtggatattgaaataaccaaagttaggacaggagcagtgttggaggaaaaaaatattatatatagggttagggagtatcctctgtttcagtcatcccctgtgggtctcggagcatatcctccatgagtaaagggggtaccactgtaggcaaatgtctagaatgtcagatggtaataagcatcatggggaaaaataaaacagggaagtgggatgaagagtggtgggcagtttgcaaacttaaatagggcattcagggaagatctcaatgagaaacttacccttaagcaaagacttgtatcagacgaaggagacagctatggatatctggggagagggctctctggcagagaaaacaactagtgcccaacccctaaggtgggaacatgccatgtgtcctattcagtgtggctggggtagaaccatgaggaggaaagaaataggaggtaggatgagagaatacgtggcatgggtgggagacaaacagcacaggtctttgaaggctatttgtgaggactttgtctctttaaaaatgaagatggtaaagcaccactggaggcttttaagcagaaatttaagaagatgatcaagtaaagttgcagaattacaacaggtgcaagaataatcttacataaaaggggttgacctgatgtaccaggaagagatcgtgttttggagttagttaatactgaatttctatcctagtatttcccttatggccaggtgacctcgggggacttacctgatatctctgcaccagtttccttatttgttaaataggaataagaatactttctattgaatagttaggcccaaagtgatagactatctgtaaagaacccagcacaaagctaatgctcaaaaatgacttattattaacaagaaaattcgtgtctgactattcagaaaattgatcagaaattatgaatcttttcttaaagtctatgtgtacaaataaaattgctttataactcagatattactacaatcatttcttataagcctatactttccatgatctatgaaatctttcagcgtttactattgcaacataatggattctgcaatggaaaattgccgtatcctgtaagttggtgagtcagcattctaccacacagtgacaaaaggaaaccagggcaatttttagtccattttcacactgctgataaagacataccagagactgggtaatttataaagaaaaaggtttaatggactcacagttccacgtggctggggaacacagttgcccaatgtggactcacagttccacgttgcctcccacctcacaatcatggtggacggcaaaaggcaaaaggcacgtcttacatggcggcaggcaagagagggaatgagagccaagtgaaagggggaaccccttataaaacgatcagattttgtgagacttattcactaccatgagaacagtatagaagaaccacctccatgattcaattatctcccactgggtccctcccacaacatgtgggaattgtgggagcaaaaattcaagatgagatttgggtggggacacagccaaaccgtatcaactgccaatagtctgaagctgaaacacaagcatagcctcctcctcaatgttgaatcccctcccttctcaacctcacaacccctacacacacccaaaatgatcatcatcatactggcaaaagggtcaggctcaatgctgcttgtgggagataaaaggtccacttttttttaagtgtttatttcttttagactcagaggcagaatgtaattaacaaaatagatttccatgtcctggcagagatagtgtgtcagatgacaatgcttgattatttcctcccacctgatctaggagtaaactcccagaaaagtgaaaacatttagtacccatccacatttacttgggaagaactgtgtgcctaattctacatgctaaaaactgctttttgtgtttctgttatttattcaaaaatttaatccaaggttgatttatacctgtcattatttagcctgttgccagcatcctccaattaattgtaaaatcacaagtaaaacctgctacagaacatagtatacatggcttttgcctttactatttggtcctatgcagtcttgtttctcttctttcattatacagataattgagacttgaaatgggcaaaatcacccaaaattgagaagagtgtgtggagaagtcagaatcttttggggttggaaggctgaaatcaaatttatgtaaaaatagcacagagcctagcgggcactcactaaaaggtagagttatttatacataaaattgcaaagaaggaacagtgaagaagtaattatcgtcctacttgctcaacaaagaacaaacttcagattctttactgttacgagctcctggctaaagagggataattagttaataaaatggttcagaatttacaaggtttagaacattttggcagtgttgttttcctagtattcattctcagcaaaaattcttttatgttctaccagtttttgtcaaggtaaaaagcccttacttaaataagtaactttagcaaaaccatgctaaagaaatattttatgaatttgcaaattatttttagagaagaaaagctatctagtttactttttggcctggcatagataggaaacatttactcagactgaatcccctaatataaaatgcatgaccatttgaggccattgctctagacagtggctcctggtgttttggagaacttttatttaaagtaaaaatctttcggggatgatagtagttgcactgttagtcagttgaagagctacaaaggtttgtatgattttgaggatctttgcactaactgctttatccctctcccaccagcaggcaacccactagttggggactgctctgcaaataatttctcaatagttatgaaagtaaccttgccaatatagattgctgtgatttaatgtattaattcttttttctcataatagtggctgtggtagtaggagatgctaccaatcaataaattaggattttgggggaaaccaagtatcctgagttgtcaatgtgactcttctgttctgaaaattcctagggctgaagcagaccattccctgttcttgtcaagaagtcagcatgcacaccattctggaaagatcattgcctactctctctctcttcaaattctttcatgatcttccttgcagaccctttgctgtgcctctggagatgtgagcgtgtgacttaggagggatgacctacttcagttgcttccccaacaactcggctcctttggcatgggtctggcttggtgcccaagctaggtgtgcaagacggcagtttgtcttgtgtttgcaactcatttcacagtcggtgagcagggcagcctagcatgcaagcctcccctggctttgcatctgcaggaggttcccttctccaagggagctgcaccaagagcttcacttggtaagcacagaaagaaagtcaaggagctccaggctgatgaggtatttggggctcaatttccctcccctcagagggagatccagtccctgtcaaattgccaggaggtgcagattagcagtcccagctcagtggctgtgacagaggtatcagcaataatatagtcagggctgaggcgagttgagggccacaaactttaatctgttatgcaactattactactacttccacagggaccatctttacctgctgcgtcagattaggttgtccataatatgatttcaacacaacatcccaacactatccttttgcctgaattatgtaattttttttcctctgaacacatcccatgttttcctatagacatgcctttgttttctctcataactctatcactgtctgttgcaattctgctcctcacctgaagcccatctcaaatactatctcctttaataaagcttttgctgatcaccctaactagaaatggcatgttcagtctctaaatatctcctatggctttttacattaaacttatgttacagttacttattcacatttctcctaaatttgactgtaacctttttaaagcagaggctgtgtcttatccttataactactggagctcagtaggtgcttagtaaaatggctgtggaataagtgagtaaatggaccatttgcactagggttggcagagagctggtggccaggaccaaaattttatttaggtcaaaaattttatcctggaacacaattgaataataaaaaaacaaaaatccaatgaaaatgggcaaaaaatttgaacagaaactgggtaaaagaaaatatacaaatagctgacaagtgcataaaaagatgctcaacatcattaataatcagggaaacacaaattaaaaccacaatgagagacccattagaatggctagaataaaaaaaaatgacaattaaaagcattggccagtataaaatgctcataccttgctggtgagaatagaaaatgagacaacccttttggaaaacagtatagcagtatttcctataaagtatacataaagacatatatatagagatataaatctatcctattacctgttaattttactactaaatttttatattagaaaaatagcatgtctatgggaggtggggtgaggcatgagggaactttctggataatgaaaatgttccaagtcttaatcaggctagagtaatatagttttgtcgaattgcatcaacctgtacacttaaaaaattgtgtacgttattgtatgcaaattatatttaaaatatatgtttgctcaggatcatcctagaaaatcgtgtattcacctgtgtctttcaggcatgccggtaaggactctgccacaaattttcagccacctaatagtattatcttgtgaagatcatgaagagtttaaaaaaaaaagaaaaaaaagaaaccaaagaaatatgacagtgccatgacccttgtattaatttgatcagctaaaaacaagaaaagtgtgtttttgaagtttatttatgctgatacctgtaatgaaaactcaaggatattattacagagatttcctcttcttaggaggtacttactcaacaatatgctaaatgctatattaaagtgggttacataatttagaatttagagaactctgattattatgaaaggcattgcatttcagtgtgttctttcctctgagatttaaaacaccaagcacttctctttcaaaataagataaaaagaaaacaaggtaatcaaaaatggaaagtataaaaatggaaaatgagattgcatatcttgattaaaaatcaatcaataaaaaaccttattatacttccaaactaaatttataagtctttttgaaaaacagcaaatattggataatagatcctctgactctagatattgcacctgctttaaattagattatcttttgagaagtgaccttgaaaaacaatgattaagtgggtaagtttgactttttagactattagacgtgactgtattctccctcaaaaacctttataaggcagaaatatatatggcatctgattctcttttctttagatggagtttacgatttttgaagtttggctttgacaacaaatgacaatgaaatcatggctatttgatatttagttacaattcatccaatatttattgagcactttctgtcttctgttttgatacaggaaggttataaaaagtataagacaccacttatttcctctgggatcttaaaatctaattatggaaagaagctatgtgggaaaaaataatggagattttgacaaaagatcaagacaagaattaaagagacatcacatgtctatgtatgattagttaacaaattcattttcagacaacaactatgcttggaagttcaggaatgagactggactcttctttgttcatttcttacttttctcctattgacctctcacatgctgacatctccattgtcttctcttcctatgctttgtggctttgttattaaattaagtgttaatttttttttttttcttagacggagtcttgctctgtctcccaggctacagtacaatggtgcaatctcggctcactgcaacctctgcttcccaggttcaagcgattctcgtgcctcaacctcccgagtagctgggattacaggcgcctgccaccgcgcctagctaatttttgtatttttcagtagagacggcgtttcaccatgtaggccaggctggtcttgaactcctgacctcaagtgatccacaccgcctcagcctcccaaagtgctgggattacaggcctgagccaccacgcccagcctaatttttattaaaataatgcatggacctatttttaaaaagcaaattatactggaagcttgttaatacaagaggcagcccttccctgcagtctggtgtctgatgtcccagaagtaaccccttttaacttctggtatttccttccataagtgtaagtatttcttgatgtattgtttttaggttttatccgctaactctctactatagaagatgaggatttggctttcttttatcatccctcacccctacacatttcctctcctgacacactcttctactctcctgaaatagttttgtgacatatttggttaaacccatattcagtactgtggttattgcaactttgcatattgcgctttcatttcctttgtcatgtaactgtttgttttttttttcataagatgtccatctgtctctctctttttatttgggtgtctttgtttgaacaaacctcttgctaagttttctacatgctccaatgttctttaaaacacctctcaaggccaggagcggtggctcacacctataatcccagaactttggtaggcctaggcaggtggatcgcctgaggtcaagagttcgagaccagcctggccaacatggtgaaaccccatctctactaaaaatacaaaaattagccaggtatggtgttggcacctgtaatcccagctacttgggaggctgaggcaggagaattgcttgaacccgggaggtggagattgcagtgagctgagatcgcaccattgcactccagcctgggtgacagagcaagacttcgtctcaaaaaaaaaaaaaaaaaaaaaaaaaaaaaaaaaaaaaaaagggaaaagaaaacacatctcaaaccagtttttcacacaatgaattc

SEQ ID NO: 13 - DNA, 176562 bp, Homo sapiens
gaattctctgggaccttcctggaaacctctctgttttataaggttagaatttaaggagtcataaacacaccccagatgtctttcatgagtattgatgaccacactgttctcttccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtgagagttcctctgactgagttgcctggttgcttttccatcctaaattaaccacctcaatttttgtcatttctacatcttgtgctagaaagtctttgtgtaatagttaagcctgtccctccaaagactgatattctttgatttatagccttttccatttgtcgctccatcactatactataaagagaagactgggttgagttgatgaatttaaaatgtgtcttcggggttgccttttggagcagttttaattttatgaagtgcttgggaaagtcaaagaaacttgaagtaaaagtattaatcactttgaacacttagaaatgcttttatttctggttactaaaaatcattgttgaaaatgtaaatatggaattagagggatatgaagtctgccagctgagtctgctaataacaaaacttttacaagaaagactaaactacctaccattccttactttttttgcgtatttatttttctttttctttcttttctttcttttttttttttttttttgagacagagtctcactcttgttgcccaggctggagtgcaatgacgtgacctcggctcgccgcaacctctgcctcccgggttcaagcaattcttctgtctcagcctcccgagtagttgggattacaggcatgcaccaccatgcccagctaattttgtattttcagtagagatggggtttctccatgctggtcaggctggtctcgaactcccgacctcaggccatccgccctcctcagcctcccaaagtgctgggattacaggcgtgagccaccatgcctggccacgtatttatttttcatttagcttggaagtttactgagaatcttaatatgccattcttgatcagaataatctttctttgcaagaagtttaagagtttggcctcaggttggaatagggtgtaaactagactttgatcaagaagaaaccaatgagaagccctctttgatacttcgtacacagcttctttctaccagaaccagtctgtgggaggtaatcctaggagagtctaataagaggtttggtttggtttgatttgataaagaagtagctgcttattgcatattgggactaaataaccaaagttctttgtggcttaatgtgcttttccggtcatttggtgacaggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggtgagtaaacctgagggctaccagactgtggcttctgagatggatcagtgggcacctcacctcagactagggaaagtttcctttgtgcgaactcttgtatgaactttatatagctccccaagatcttcctacctgaaattgatttctgaagaatagtttaaattctttgcatttgctaaatacagagctatgagtagcttcctggacatttccaaaacaaagcacttttaaagggctctttttttttttgagacaagatctctctctgtcatcacagctcactgcagcctcaacctcccgggctcaagtgattctccctcctcagcctcccgagtagctgggactacaggtgtatgccaccaggcctggctgaattttttttttttttttaagtagagatgaggtcttgctatgttgcccaggctggtctcaaactcctgagctcaagtgatcctcctgcctcggcctcctaaaatgctgggattacagatgtgggccaccatgtctggccttaaaatgacttctgttttacagtttcactctcagtgatcagggaatattccttctgaatgacctcttctgaggtaaaacacaatttgttgattgggaacctctaaagttcagattgaggtgagaatagaaagttggttgaccaacactgggcatggatgtggcgatgtgatagcttttctcatatggacttatttggttgaagtaaaattctgaaactcgtgatagtctctgaactatgattttagtgagctatgattttagatttcacatcataaggcatattctttgttatctgtgctgaatttgggattaaatgagtctcagcttctgagtaaagaggtggaaggatccatccactgacacttaaccactttccatatttttctttaggttggtacgggggcaacagtagccacattggctgatgcttcagaattgccaaccacggtcaccgttgcccaagtgaattattctgccgtggctgatggagaggtaagaaagagattccatctgcatcttcttaaatacttgaatgtataatgagggaaaagcaagggtccagaagatggagtagcctgcatgtctgcggcactctttcatttaaaccttttaaagagcatgagaccatgaaagttttagaaagtgtcttatgctatgtgtattaattgtaacaattaagattcatggattagtatgtcaggaacttagaattttacatttgaatgtatagcatttggtattatacacaatacaaagggattatccctttaccatttttatgctgtgaatcccaaagaatttcatctttggtctttatgaaaaaaaaatgtcacattaaaactggaactgactaagggaagccttctttgaaaggataaatatgtttgcaagtcagtaacatgatttattacatcttaaatatgcctttgaaaagatttcttaggagaattcttccttaccaaaattgggataattatgggacattaacctaaagacagccaacctttattgatcacttggtgggctaaacactcaaccctatgaagtataaagttctgttatcttcactttagagatgagaaaaccgagacataacagagcttagatgatttgcccaaagtcccatagcagtgttgaagctggataatgcattgagaaaaacattacctaggctctgagccattggtgaagatgcaacagtgaaggaaggggtttgttacgtcaccatgagtgtttcccttgaagatactgatgtggtgtgctgaagtttgaaaaatagccaacagatgtcaaagagcagtatcagaaataaagctaagagtattatctcacccttgttgagagccatggagcatttccccttagaacaccacaaagtcactttcatttgtgcccctcaggagagggggagagctggcaaaggccacatggctgggagatggagggagagtgcaccacaggctccttggccaccctgcatgtgccaaacccctgtgtagctgcagctgtgtggagttgattcgcacaggatccttgctgtcatgggactccagtctagtggggaagagagatgtctacgtgaatgaactctagccttcctgtaagggatgctgcaaagcgtatgtgcctcctttccacctaaggagcctgggaaagtttgggacactgaaaaacttggttattgggtgaggaaaggtgaaggttgacaggacacttactttctaagtatataaacatcattaaaggatatggattagcaaagcaaagaatttgtcagtcccagaacactagaacaagatgacactccttaaagtctgaaagaggtggaaaagacaacgaggggtacagttaggagatgtgttagtttttggcttagacaaagttatcaaccatatgtctctactgaatgtttcttggtactatttaaagaaagtaacttcgtttccttctgtataaaataatttgtttttgacacataatatttataacattaatggagttgcgtttccttttttttttttttttttcctgagacggaatctcactctgtggcccaggctggagtgtagtggcacgatctcagctcactgcaacctccgcctcccaggttcaagcgattcttctgcctcagcctcccgagtagcaccaggcacgcaccaccatgcccagctaatttttgtattttcagtagaaacggggttttaccatgttggccaggatggtctcgatctcttgacctcatgatccgcctgccttggcctcccaaagtgctaggatgatatatagtatatataattctgttagaagagaaagccaaagtgcaaaaacattagagacgtgaattttaaactgaaccatcaatatatgtaacagttttgaattgcataactcattttaggtgcatttttatgaatgtcagtttaccttaaatatgggcaggctgaataacaaataggaaaatatcaatagtatttttccatccatcccttcagtaaacactttttgagccctgtgccaggcactgtagagactatagataaaagataataaagactcccctttcccttaaggagcacataggtaggcggtagagaaaagcaaagaacaattgcagtgagataagggtctactggcagcaagcccagggtgctgtggaacagcagaggagaggctctcatctggacttcaggggagtggaattgtctcaggaaacacttcccagaggtgtagcccctgagcttagactagagtgggaactagccaaacaaaggagagggatgggagttctatcctgtcaaagagagcaacacattcagtgcattgacttgtgaaagcatggaacagccacagtttgaagggccttgtggtagtgggcctctctcagaaatgcatagtagctaatgagatatcttctgaatatcttcctctcctagggcttgtggccctttctttggggaagggagtgcaacaagagctcaagtaaacacagtttaagaaagcactgagactcaggaataggaaattccgaagagatgctggcacttgagctgatttcttgatcacctgccgtgtttctgattagaaatctcttctctgtttctcctcctattttctcttcaccgtttactgtcattccatgccatataatttaactttcttaaattatactgtatatggcagcattctaatgccattttcactacaaatatagttgtaactaaaagtatctatattgacttgctgcctttggagtttgaggacttgagagagcctcactgggccaaactcaagtgagagcagcagcatgggccagactgaaatagaggggcagatcagaaacaggaagaccattccctagcagtaggcaacagcactgcccggcttcagtggatgttttgagcggactcatcagccacctaagaattgatagtgcagcttgcctcttatggtggcagtgttggtagtgatgttcattggagcaatgagatcaaagcaaccaaccttggaaagcaagagctttggagttcctgaggggcaattttgcagctctaggatatctctgcctcaggagtgatgggccctgaaggcttgctggcacaatccactgcccatgagaactcagggcaaacacgaaggtaactcaaaggaatgtctctttctctgagaggcttttggcaaacattctgaaaagcattatcataatctaagtatggtaatataactaaagcaggaagcatttaaaatatctacctcctagagcttggagcactttctttgggacacagtaacaagcaggcacaaggtaactactcactaggccccagcaatgtgaagcaggaatagcaagagctgcagtaagcactgctaaggtcctgagacccaggagtccaaagacagatacacctgagctgatggatcacctgctgtacttccaaatagaaattgcttttactgcccctgctgcttttcagttttgagggtgggtagttaatcaaccagtatttattgagcaaaacggactgaagtaactagatacaggtattcagaactaagtctctaaacacagagaattgtactaaaatcagtagttctgtaccccagaccagaggggacatttggcaatacctggagacattttttaccgtcctgactggggagggtgctattggcatctagcgggtacaagccgggatgctgctaaccatcctgcaatgcacaggacagccccacaaccaaggatacctgggccaaaatgttagcatgccaagactgagagactgtaggcctagcaaacctggattctcatgtatcctgtcaccagagagtatgatttttatttttgggttttttgctgtgggcagtgggagagtcttcataacttctcccctactaaaaagaaagcagtttttgctacactttaaaaaattagtttctgagtttagcagtttctatcaaaaataaacatgccaaataactttgatctataattctacctctaggcatttaccctataaatagactcacatgtaatatacaaagtataatagtatataaggatattcatcacagcactgtttgttaatagcaaaagactgtaaaccacttaaatgtgcatgaaaagatgacttgttaaataaatcatgatgtttctatataatgcaatgcttcccagcactttgggaggcggaggcaggtggatcacctgaagtcgggagttcaagaccagcttaaccaacatggagaaaccccgtttctactaaaaatacaaaattagctgggtgtggtggtggggtgcctgtaatcccagctacttgggaggctgaggcaggagaatcgcttgaacctgggaggcggaggttgcggtgagccgagatcgcgccactgcactccagcctgggcaacaagagcaaaactccgtctccaacaacaaaaaaaaaaaagccattctatgcagccatttttaagaatcatgaatgagtaaagtagttttatatgttccaaaatggaatcatttcagagatgtactgtttgtgaaaaaagcaagatacaaaagatatgtagaatatgctgccatttttattttagaggagggagtagaaaggggaaatggggtgaatgtgtgtgtgtgtctgtgtaaatatacttccatatagcaggaatagctctacaaaggtacacgagaaaataggtacattacatggaaatattgtataatgataaaataataaaagagaaaataggcacagttgtagaccctttggacaaagggtctagagtactggtatcatattccctttgatacagtttgaaattttggtatagtttgaatttttttttcctctcatggcccatttctaacaacccagcctatatatttttaaactttattatgtatttatttaaattaacaaaaaattgtatatatttatctggcacaacatgttgttttgaagtatgtatatatcgggaagtaaattgagaaacgtatttaaaagtgtagagtgggccgggcgtggtgactcatgcctgtaatcccagcactttgggagactgaggcaggtggattacctaaggtcaggagtttgagaccagcctggccaacgtggtgaaaccccatctttaccaaaaatacaaaaattagccaggggtggtggtacacacctatagtcccaactacttgggagcctgaggcaggagaatcgctcaacctgggatgtggaggttgcagtgagccaagatcgtgccattgcactccggcttgggcgacagagggagactccctctcaaaaaaaaaaaaaaggtacagtggaaggtcttgctttctgtctcccatccaacttgtttccaactcctctcaaccccacacatacaatccagagaatatattcagtggcttttgtgtgtccttccagaatttcttcatgcaaatgcaagcaaattcaggtatatattctaatacccccttttttatgcaaaaggtagcatgcttaaagctctgttctgtatattgcaggtcatgttaattttaaagagtatgtgtatttagccaaaaagtagcaattattagaaaaattacttgtaaaattgtacttttgtggctttgtttttttactatcttgtcctttctgcctcaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacaggtggtggcaagagtgtgggaataagtgaggatcgcaaatctgtccctgcagatatgggtggaggccccttaaagagaaatgtgtctctgtttgccacagttggcagttggaacttaacactcttggcccatacgatattgtagtttggcctataataggtcagtccttaccaagaaaaattaaacttctttccttcaggtgtgcttaggaaaggtgatgtgaaatggaatcctccagtaaaaggtagtttccaaaactcaatgtattgtttcctgcttagttccttctactggctgttgatggaaagatcatctccgcatcattcttcactcctgccgccacccagccccaacaaccagtgtagcctttctgacttccagcccaagctggtcaagccttcccgtttatcctattctgtgtccagtaagcagaagcagtaaggcttgagtgcttcatgttttcaagggatacagaacaaattaagaggcttcggattattgtccttttgccctacaaaagaaactgcattttgttgggggtattaatccatgtttaagcagcaaatggctgattttacttgcttttgagaaaaatgtgttgcccttgcttatcagcgagctcaagataaataagttttggattattggggaaaataatgaacttttttcttcaggtatgttaggaagggtgctgccaaatgggatgctccaagaggtggtttctgaaactcgattgtattattccctgcctggttctttctactggttgttgacaggaaagatcagcttcatatcattctccctcttcttcattcctgatgcaattttatttttaatgggctcagggatttaaattaatggtcaagagtgtgagccttgacgccagactacttgggtttgaagcccagctctgtcacttacaagctgtttggcatcgagcagttgatttgaactctcagtagccaggctctcctattctgtaaaatgggagtgataacagtacattcttctaggagtgttatgagaactgaattactccatgtgaaatccttaggtcagtgtcttgtatacagtaagggctgaactcttgcggcatgccagctctactgggtaaggctgtaaatagagaatagagtgctctagcatatactctgccctcaaagaaatcatactcttattgcggagactgatttaagtaaaacacttagcaaacagtattacttagagtgtaactcactattgaattgtatggtaaagactgtgaacgttgtagaaattcagaggagggtgatcacctcccctaaatataaaatcagtgaaagtttagattgattatgatagatactagagagctgtgatggatttgtatacagttcactgtatgaggctgtatagtatggtggctgagagcagggttccaacgtcacatagattcaggtttgaatcctggctccaccatttgatcctgagaaacataacctctgagccttgttttccccattgttataatgaggataagactcatcacacagaatcatgtatatgagataatatagataaaattctcatcgcggtgtccaacctatagttagcatttcaagaattatagttattatcatttaagttgtattttaagagttgtctattctgaattgattatagtgagaggagattagaagatcagttaggaagaggcactccaggagcgccttgttaaggtcttggaaactgaagtagtaagaatggaggtaaagtgattcttttttttttatttgaaacggattttcactcttgttgcctaggctgaagtacaatggcatgttctcggctcaccacaacctccgcctgccgggttcaagtgattctcctgcctcagcctcccaagtagccaggattacaggcatgctccaccacacacggctaagtttgtatttttagtacagacagggtttctccatgttggtcaggctggtctcaaactcctaacctcaggtgatccacccgcctcagcctcccaaagtgctgggattacaggcgtaagccaccacgcccagcctaagtgatttcattttaaaagaagtatggccagagattggtggttgattaggaataggaaactgaaacacacacacacacacacacacacacacacacacacacacacacacaacacatcttctcagagttacctagttagtccctagtgatcagaacatttttttcagcccattgagccatgttgctcttgttgctcttcatttctttttttcccccactcacgtatatactcatcatgttgcttttcagtaacatgaaagtcttacttggttccttacacttggctcaattctacccctctctttgagagaaacacccagataaacttcctgaaaggcatggccaagtgagaccctccgtccctttagtccagtaacaccccccattctccgcccgactgtagcttggggtctaacaggccctcattaaagaccagcaaaacttgatttcattgagacttgcagccaacaccttggatattccagtgaagtgtgtgtgtcctgggaactctgtacatagtggaaaatatgaggcacatttgggctctctttgttataaggaccagggcttgtttctaaaggcaagcgggtaatggtatcccctgagggcttgttaacaaacttagatgcagctgaggtggctcagtgtttactccaaaggaaggagaatgtgttcactgtggcatagaggaggaataaagagatgttgaaatctctttgcaatcaggtagttcgatgccccaatgagtgttaggggttggtggattgcagcttctgctggggatgaagaaaccaagcctggcagcagagactagactatagcagactattaggggaatatcagggctttctgaacccaacagaggtaacccatggtctaatgtcttagtcaggagggttggatgtaagaaacaagcccttaacattcgcttctttgtggacgagatgcagtagaatcatttagtccttgcactctgagcctctccacagaatttgctgttggaagtcatctcagtaagaaatacacagagaaatctggtctttgttcctatgatgacaaagcagtttcataatctgccctcttgcagcttgctctgttttgggtgcagataaaacaagcatggttctctaataaccacctgcacctctgctgcaatgtaaacagcagatgtgggcgcagggtgagaagggagaggaagctacgtgcaatggcaggttggggaataaggaggcagaggggctccttcatcttttacagggtaaaatgggatcaggacagttgcaggacagacttgtttctcaaccacgctgttaagagaatttcatactgcaagtcacaagggcccagggctccacggcctttagcccaccctggctttctaacaacccaaagtgggtatggagaaattgtcctttaaaaacctaaaaactatgttaattttcattttcaaaataaagaataaatcagcacttttggaaaggaggtgggaagggaatcaaagtgaacaaatgagcagaacatcacagctttaaaaaaatttgtgtgtgtatgtgtgtgtatatacatacatacatatatataataccatatatatgtatataaaaaatagcttatatataagctatttagcctgaacaaccagagaggaaaggaagtaatattatcatttacttgtgatacagtgattaatttgaactttcagttctttggttaagctgtcctggacttgtagttcctcttaaacatgtccttctacaaacccatttcctgaatatggccagtatagtccttgcatgtagagatcatgatttggctttgtagacttactctacgtttctaaagtagtggaaacttacttgatagtatattgttaacactgagacagtatttattgtgtgtctactgtgtgcagggctgtgactcagtgctatggggaaatatttagattaattcctcttctcaaggaattttagaatttgtctttttttttgttgtgaagattttgcttttaaaagtcatattttgaaagaaaaatttgctcttagtcttttttttttttttttattgagacagagtcttgctctgtcacccaggctggagtgcagtggcgcgatctcggctcactgcaagctccgcctcctgggttcacaccattctcctgcctcggtctcccaagtagctgggactacaggcgcccaccaccacgcccagctaattttttatatttttagtagagagggggtttcactgtgttagccaggatggtctcgatctcctgacctcgtgatccacccgcctcagcctcccaaagtgctgggattacaggcatgagccaccaggcctggctgctcttagtctttaagatgaaatattattgacttaaaattagacatattattaaaataaaatggggcttttatatacggagtgatatttgtccaataaaatgggatggaaaacttagatcagaaatcttctctggaagagaagtcagggatggtacaactgcttttctttcctacaggtaaagattagacgcttacagataaaaggttgatggaaacctcttatttatagctttggttttgaaatgacttttgtctaaaaattgtgaagtggtctagctcagggcctttttaatccctattcacctttttaagtgaacataatctttttctaggctgggcgtggtggctcacgcctgtaatcccagcactttgggaagccgaggtgggtgaatcacctgtggtcaggagtttgagaccagcctcaacatggagaaaccccgtctctactaaaaatacaaaagtagccgggcgtggtggtgcatgcctgtaatcccagctagtcgggaggctgaggcaggagaattgcttgaacctgggaggcggaggttgcagtgagccgagatcacaccagtgcactccagcctgggccacaagagcgaaactccgtctcagaaaaaaaaaaaaaaaatctttctagcagtttagtttggtcgtttcccataaagttgagtgtaaaaggttagaatcactctggaaatgatagccctgcttaccataggcatcatcgttgtcttcatgccccacgtaaagaccttaactggggactgaataattaatcgtactgatctgtcaacctgtcacccccattgcattggacccctcatccctggcattccagattgttttaggttgttgctggttttcagcttttcttctaccataccacattttagaaagaagttaaagaagataacttcaagtttttagggctttaagtggaaatgagtatgatcagttgcaggtacactttcctgtcaaggcttggggagctgccctctcccttcactgcccatgaaactcattctgccagagtgtgttcaggatgtacaggagtggcaggatgtcatctttgatggtcataaagatgagattattgtaaattgtaagaataattacaggaaataagcagtcactgaggtgacctataaacaaagatcctaattccatataaacaattctcatttacagttttcttcttcagactatcacacagctttttccaaagagtatacttttctgctttccataaagtctcaggtcacagcgtaaatatttgtatcattaatcattgacaggtggatgctgtaaaattggctggtcatatatttatgtatctttttctttttttttctccgacataggtaattaataaaatttccaggccgggtgcggtggctcatgcctgtaatcccagcactttgggaggccgaggcgggtggatcacctgaggttgggagttcgagaccagcctggccaacatggagaaaccccgtctctactaaaaatacaaaattagccgggcatggtggcgggtgcctgtaatcccagctactcgggaggctgaggcaggagaatcgcttgaacctgggaggcagaggttgcggtgagccaagatcatgccattgcactctagcctgggcaacaagagcgaaactctatctcaaaaaaaaaaaaaaaatttttttcccagtggttggtagtagtgtttattaacataactttcttagcaaaatattaaaaattaagggcctaggtactaaaaaatattcattaaagtctctctaataaatactttaaagcactttaaaattaaattctgtcatgaaaaatgtaaagaacagtcttagtagtaattccagatcaagggtctcctgttgaaaagacagtcctttccctattgaatggtgttggcacccttgtcaaaaaccatgtgaccatataggtgaaggtttatttctaagctctcaattttattccactggtctatatgtttgtctttatgccagtactatacactgttttgattactacagctttgtgttaagttttgaaatcagaagtgtgagtggtggtgctgggaaaactggatatctacatacaaaagaatgaagttggacctttacctaacacagtgtataaaaattaactcagagtggttccatgacctacaactataaaactctttgaagaaaacatggggcaaaacttcatgacattggatttgccagtaatttcttggatatggcaaaggaaaaatagacaaattggactttacgaaaattcttaaaatgtgtgcatcaaaagactatcagtagaggaaaaaggcaagccacagaatgggagaaaatatttgcaaattgtatctgataagggattgatatccagaatatatagggaatgtctaaaactcaacaacaacaaaaactctattcaaaaatgggcaaaggtcttgaatagacatttctccaaatttctccagagaagatatgcagatggccaataagcacaggaaaagatgtgcagcatcactaatccaaactacaatgagatatcacctcacacccattaagatggccacaatccaaaaaacagaaaataacaagtgttggtgaggatgtggagaaattggaacccttgtgcactgttggtgggaatgtaaaatgacatagccactgtggaaaacaatatgataattcatcaaaaagttaaaaatgggactaccgtatgttgcagcaaatccacttctgggtacatatcccaaagaattgaaagcaggatctcagagaaatatttgtatgcccatgttcacagcagcattattcacaatagctaaaacatgggagcaaccaagtgatcatcgacagatgaatggatacacaatggaatattattcggcctttaaaaggaaggaaattctgacaaatgctacgatgtggatgaatcttgagcacattctgccaagtgaaataagccagacacaaaaggacaaatactgtgtggttgtatttatgtgagatagagtagtcaaaatcacagagacaaaaaataactcaaaatggatctaagacctaaaactatcaaactcttagaagaaaacatgggggcaaaatgtaatgacattggatttgcctgtgatttcttagatatgacaacaaaggcacacacacctatagttccagctatttgcgtcaggaggctaaagcaggattgcttgagcccgggaattcaagaccagcctgggcagcatagcaagatcccatctctaaaaaaataaaaacaaaaatgaaaaaatcatcgaggcagaaagtagaatggtggttgccaggggctagggagatggtagaataggaagtttaatggtccagtttaaagttccagttttacaagatgaagagagttgtggagatgaatgatggtgatggctgcacagcattctgagtgtatttaactccctgaactgcacacttaagtgttaagaatgtaaattttatgtgcattttaccacaacaaaataatttttcaaactgtacagtacaatcctaattattatcttttttttttttttgagacagtttcactcttattgcccaggctggagtgcaatggcatgatatcggcccactgcaatctccacctcccgggttcaagcaattctcctgcctcagcctcctgagtagctgggattacaggcatgcaccaccacacctggctaattttgtatttttagtaaagacggggtttctccatgttggtcaggctggtctcgaactcccgacctcaggtgatccgcccgccttggcctcccaaagagctaggattacaggcgtgagccaccatgcctggccttatcttatctttttgaagttgtatttaagattagaaggaaataattatgatatttaaaattttcttttatacttaatagagtttgctcaaactttctataaaagcaagtatactgcttttattatcagaaaaagataactgtttaaaacacaggcataaaaattaaaaagcaagacaaattagtaagaagaggaaattcttctatttaatgacacttttctgtccattcggtttcttttcctgcttcctaaaatccttacagtgaccaagaagtcttttgcaggggaattactatatctgttgttttacttgtgtgctgactgtcttaggtaaaggagactgtattgagtttggtacatgttgctttgcccacagtcctaacatgtttactccaattagtccctgtccccttacccacctccacttacggcttgtgcttacaagaccactgccatgttacagcaaatcctgcagcttcagagcaaagctgactcgactggcttatttgtccacttctgctaaactaaatggcaccaccatctctattctgtgcctactggaattcgatagtccctcagtaattgcaaattgacacctgatactttaccagaagggataatgaaattgcctgttttttcacatttttacatctctgaaatttggatggcaaattataatcttacaattgtcaggaatttttcttccttactggcccatgaaataatagtatgtcttacagtttgtagcatcatagaatcaagaaaaatgggtatttatgcacatagtaaaagcatatagcaaggaaaagaaagaaaaatgggacacactgctaaaatagtacttgctataaacaaatggttaatgtcttcctattctacagagcatttgtgctatgtagggaggtttattattttgttgtaattatagaggcaaactgtatttatacagtttggacttgcagtgataattttaaactttaagtctttgttttagccctgcctggatatacagtgagtcaaagggaagagctggacttttcaggatattaatcagccattactctgtatttgaaaagcataactataaatcaaattaatatttagtgttaattgaagagtgagtccaggttgctgctgactcctcatattatcattcatccttggctataaaaggacagtctcagatggtctgccttatgttactgtgaggagaaaagagaaaaggaaaaccttgtgattgacaaccaaaatggcttttgcattgtgaatatggatcagagctttcactatggcttgcaagcactcagctgatattgataaggaagaaactgataatgagtgccttctgtcctcaaacactcaattaccgaggttctgagaaactctcaccattagctttatagctatgtaagacttgagatttctctagccattaatattatttcaaaattactcttggctttatctattagcactgttatcacatatttgctggtaggatcacaaccatggagtcagtagaaagacccaaggaaggcattgaaaggatggtttgtcttggctgcagtgctgttcctctattcatcatcctctctcctgttcctgtgcccgcagcgaagctgccgcccatgctgtcgccaccctggctgaggccaccttacaaggtgggggacagatcgtcttgtctggggaaaccgcagcagccgtcggagcacttactggagtccaagatgctaatggtaagagagcataaatattttattaaatttcttccctgtttccacttaaaccttcctgacatgactggcaacaaagccttcagaaagagtttgagcttcgatttttttttcttcattggtagacatttcatgcctaggaatattctgggagcctgtgattcctttcactagtaggaaacatgggggttcctgaaggaaaatactgtgataatggctacctaattgaattgttacttaaaaagtgattatcgtcttgtgacaagacttgctgagaagcaccttaaaattcactgtgagccacattttgtcttttactgtctcatcggatagggtagatcaatgtcctttactgtagcagagactctctcatgggcaggaccatcatggaaagttctgactacatcaagaaaggcgccaatgtctcacctgtgcttggggtcaggcagcaggctgtgatgccggtgcctctctggttggtactgtggttctgcttcctgttatatgtagcctcacgaaggacctttggatttagccaattacatgcccctaccctgagcttcttccccagctctttgacttcctggacattggtgaatatcctgaataagcaaaagggataaaattcatagaaatatggtggcaaaaatatacaacttcagcccagttctttgggtccatgttggtaaggagtcagttggcaagacaagctgcccaaggaagtgcctcagaagtctgggtcaaagaggagggccagatctgttctgtgagaccctatgtgattgttatatttttaaataatatataattaagcaggacaaattaaatactccatggctttggggaaattgttgctttaaagtcctggaatggggctgggcacggtggctcatgcctattaatcccagcactttgggaagccaaagtgggtggatcacctgaggtcaggagttcaagaccagcctggccaacatggcaaaaccctgtccatggtggtgtgcgaggctgaggcaagaaaatcgcttgaacccgagaggcagaggttgcagtgacctgagattgcgccactgcactccaacctgggtgacagaatgagactccgtctcaaaaaaaaaaaaaaaaaaaaaaaaaaccaatcctggaatgaggatagataaataacatactttcatcatgtaggcagaaggttccttaatggcattagtggcagaaagaaaagtacctggcactttgtttatggtaggtgcctaagaaccgaatgctctgttagttggaaaagtctttgaagaaagacatagtgctgtgtcctcctttggaataggaggaaacaaagtacctctgtcccgccagagaagaataacataggaaatgcaaagagccatcgtggcttctgagaatcattttccaaagatgccaaacaaattcaattctaaaactatagcctactttttctgtagggaaagaggcttttgtgcttatctaaatctagacagagttgatctcaaccagaatgctgtaggacaaaggacatcttatagccacacatgttcaggatgaaatggaccatggttggaattaaggagaacctctctctctagctagactcctacttctatttttttacctttttctattcctcatcagagtcctaaggcaccctgagcaaagggtaggatatctggcttatgtggcattcatgtgaagtgtgattgctcttattcactatggaactgctaaaaataacttcccatgtgggttcagtaggaaactttattatccattctaatcgacttgacctgtctgggagagaacagactgctttataattctggctcctccccagcatcaccttttcagatggatgaatttataataagtccaaggaccctctggctctcggccaagtagaaccgttcagccatacaataaagttgaaccacacccgctactattgattactggaagctgcctcttttcagtagcattgggttgtgtgaatcatttggtgtgatttcatgttgttggctacatttgtgatctgggaaaattctggttcgcatcctaaaagccagtatttcccccaaagcaggccatcctcagtctgtgactgccagtacttgctgaactcaggccttgagagttggaagttatctctttctgaatgcagcatttctgtatcaaatcagacccttgagttgtgccgtatcccagcagttttaggcaaaggccaatcatttcatctgcccttgggaatccaaagaatgaatctcatatgggatatgatccaagtaactttgataatcctcttatcttctaacatttttgcccacagtgctatagtatttactttgggattggaaccagatttttccctcttaatcagcaattttgatatctggctagacttttagaggttctctttttcatcattctttcggattctgtcctgttgccagagtttgttgcttctttttgtttttgtttttgttttttgagacagagtcttgctctgtcacccaggctggagtgcagtggcacaatctcaactcattgcaacttctgcttcctggaagttccaatgattctcgtgcctcagcctcccgagtagctgggattatagacgtgccacaccacgcccagataatttttgtgtttttaatggagatgggccatgactggtcttgaactctggcctcaggtgatccacccacctcagcctcccaaagtactgggaatacaggcgtaagccactgtgccgggcctatgtttgtcacttctgggcagacaagcttatggtatctgccagtaggtcacatttttttttaatcttttttctttttttaatagaaatgaggcctctccatattgctctggctggtctcaaactctcgggctcgagcgatcctcccacttttgcctcccaaagtgctgggattataggcatgagccaccacaccctgtccaggccaagtttttttaatcagaaagagtttattatcaggaagaaccagatgatagcagaacaaggtgctgtttgttgacatagaactaacttggaaacagatactacttaggggaaaacatgtatcccatatttcagagtatggtttaaatcaaaattggaatagcagatgactcttctgagagcaatttggatatcattcagttctgaagtagaaagagtttgtgggatggaactagcagggatagaggaccactgcatgtggagcctgatgaagtccataaccattgggaagtggcgcgggcgggtgaggttatgaagcagtatcctaggggatggtgtttttcaagttagagataatgacccataggccaggcacagtagctcatgcctgtaatcccagcactttgggaggccgaggtaggaggattgcttgagtccaggagtccaagaccaacctgaacaacatagtaagaccccatctctacaaaaattttaaaaaattagccaggagtggtggtgcacacctgtagtcccagctacttgggggtctgaggtgagaggactgctagagcccaggaagtcaaagctgcagtgagccatgatcacaccactgcactccagtctgggtgagagatcaagaccctgtctcaaaaaaaaaaaaaagccaggctcagtggctcacacctgtaatcccactactttgggaggccaaggtgggtggatgacctgaggtcaggagtttgagaccagcctgaccaacatggtgaaaccctgtttctactaaaatacaaaaaattagacaggcatggtggcaacacctgtaatcccagcgaatcgggagttccaggcacgagaatcgcttgaacccaggagatggagattgcaatgagctgagatcatgccactgcactccggcctgggcgacagagcaagactccgtcttgaaaaaaaaaaaaaaaaaggtaatgacccatgcaagccagaagtttaaattttggatcaccaaagcagacctgatgaagacattgcacctagcacctgcgcaccctgaagacttctttctggacatgtaccccacactaccccgacactaaaggaactacccaagcactcacattactttatttctatgttctctgtctttttcaatagagtctttggtctcttaggatggagtttcatggttcggttcaatataaagattttcacagatgccttttcatttagatgtaggtagaattgcctaaggctggtgaaggctaccagattaattccttcctttacttgtttgtttgtttgtttgtttgtttgtttgttttgagacagggtctcactctgtcacctagactggttcactgcagccttgacctcaggctaaagctatcctcccacctcagcctactgagacgctgggaccacaggtgcgcactgccacaccgcgctaattttttaaattatattttttgtagagatgggatctccctttgttgcccaggctggtctcaaactcctgggctcaaaatgatcctcccgccttagtctcccaaagtgttaggattataggcatgagccactacacccggccctttacttcattttttgaacatagttatctcaatactcttttcatcttatacaccttaatgtaagaagtcatacagttcagcccatttgtttttcttcactctgccttcctctctgctggtccccagaaccccctgtgttccaggactcctgacctccaggactgacagatacaggcattcactcagacttgaggagctctttgctgagtgcctctcacctctcacccagaccttaacacccattgttggcaagcctcagaaaaccaggcctatagacctttctcttccttcctattgcagcaaacgtaatgaaagagaaggattatattgggacttggccacctcagaaacactcttctgtctgagatcttattgcagatttatacagctatctttcattcctgaaaagtagatgggggaaaacaaaatagattaacaagttcgtaagtattggttggtgcaaaagtaattgtgggtttttttgccattagaaggaatggcatatttgaagttggtgcaattactttcacaccaacctaataagcctcttagcagagctgctaagaaagcatcagcattttttaatatagctgacacttttcctaatgatgctacaagaaaaaagagaggatgtagcatttgctggtttggagtggggtttttttgggttttgtcctttggggtttttgtttgtttgtttgtttttgagacggagtttcactcttgttgtccaggctggagtgcagtggctcaatctcagctcaccgcaacctctgcctcctaggttcaagtgattctcttgcctcagcctcccgagtagctgggattacaggcatgtaccaccacacccagctatttttgtattttcagtagagacagggtttctccatgttggtcaggctggtctcgaactcccgacctcaggtgatctgcccgcctcagcctcccaaagttccagaccagcctgggcaacatggtcaaaccccatctctactaaaaatacaaaaattagccgggcatggtggtgggcacctataatcccagctactcaggaggctgaggcaggagaattgcttgaacccaggaggcagaggttgcagtgagctgagattgcaccattgcactccagcctgggcaacaaagcgagactgtctcaaacaaacaaaaggttcatcttttaaatttgaaaaaacttttattcaaaattccaaagagtgttttgggaatatgaactttatactgattttaaagttcatttgaaagaataaaacctgccgtgtgcggtggctcacgcctgtaatcccagcactttgggaggccgaggcgggtggatcatgaggtcaggagattgagaccatcctggctaacacagtgaaaccccgtctctactaaaaacaccaaaaattagccaggcgcggtggcgggtgcctgtagtcccagctactcgggaggctgaggcaggagaacggcgtgaacctgggaggtggagtttgcagtgatccgagattgcgccactgcactccagcctgggtatagagcgagactccgtctcaaaaaaaaaaaagaaaaggaaagaaaaccctatcttagccattttttatgctaacaagcctttaaacagaaccactaataaactgtaaaattgactcaagttttctcctctgcttctaccccagctttccccaggttcagggttatagggagttttcatcacagagatggaccaggtgagggaagcaagtgttcttgcactttgaaatttcactttctcctttatattcttttgatttttttcaatttcattttttgtaataaagatgttagtggaggcccgacaaagtagttcatgcctataatcctaacgctttgaaaggttgaggcaggtggattgcttgagctcaggagttcaagaccagcctgggcaacatggtgaaaccctgtttctacaaaaaatataaaaattagcccagcactgggctcatgcctatagtcacagctactcaggaggctaaggtgagaggattccttgagcccaggaggtcgaggctgcagtgagccaagatcatgccgctgcactccagccaggatgacagagtgagactccatttcaaaaaagaaaaaaaaaagatgttagcaaggcataccccacttgtggagctctctgacctaggacatcaacatacttctcagctgttgaccttgcattctgtctctcaatcctgttgtatcattattttattcatttaacaaaatttacataatcttactatgtataagcattctaagtgttttacatgcattatatttaaaacgcatgataactttatgagtaaacactgttaaactgatttaacacatagggaagctgagacacagaaagtttcagtaacttaaccaagttcacatagagagtggcagacaattcaggcaatttgtttccaaaccactgtactacactgtctccctttgatgtgagctctgggttcctgcctagactccacaaatacagggtgataaccattgttgaacaaataaatttggaaatgtcaaacctttccccacccctgccagaggctgcttgccttagtctagtttagccacagcacccatctgcccagctgttccgagggctgtaggggtaccctggaggttcatgctgctgagtgccccgggctcagcagccctccctctgcacacacacaggcttgcctttgctggccagaggagccgacaggtctgtatgcttctccggttgcagaactcatcattggctggctgtcagccttaaacattttcagtgagcagagtactttgcaattagtgaatgtgtcttcttgactggagttgggtggtgggctacgggtgctatttagagccagggaaactaaggggaagtagatgatattcagaaggaaggaaccccagcagacgagttgtttcatcagctcctagaagcctctgctcaagccttcctgctgcccttcagtttaggccaggactctttcagccttcccacctgtctctaacaaagttgagaccaaggtggtagggctgtggatcctggggaaagggtcaggggcgtgttcatttttgcctggagcgagtttattggcttatttgtttccccagctcctcaccgggtcttccacttggctctgcctacagcccttgcttggggtcccccagagattttgaagagcacatctgtctccgctggtcagcactgaagactcagaaaccacctatgctgccctggttaagactagggtctcaaccctccctcctcatgttctgaatgaagagaaatggactggagggctgtttaaaaattaaagctgctgggtgcggtggctcacgcctgtaatcccagcactttgggatgccgacgcgggcggatcacaaggtcaggagttcgagaccagcctggccaatatggtgaaaccctgtctatactaaaaatataaaatttagccgggcgtggtggcacacgcctgtagtcccagctacttgggaggctgaggcaggagaatcgcttgaacccgggaggcagaggttgcggtgagccaagattgtgccactgcactccagccaggctgacagagtgagacttcctagtaaataaaaaataaaaataaaatagaataaaaattaaagctgatgacaaggcattgtcattacacttagagaaggaacagcccttcgcaagtatcctcagggtagcgtgtcccacgttctgggctggtcctggcaacagtcttgctgctgaggttccaccttaagacttcaacgtcatattttctgaaactataagaccaccgggcgcggtggctgacgcctgtaatcccagcactttgggaggccgaggcagatggatcacgaggtcaggagatcgagaccatcctgactaacacggtgaaaccccgtctctactaaaaaatacaaatattagccatgcgtggtggcaggcacctgtagtcccagctacttgggaggctgaggcaggagaatggcgtgaacctgggaggtggagcttgcagtaagcctagaccactgcagtccagcctgggtgacagagcgagactccgtctcaaaaaaataaataaataaaatacaaaataaaaaaataaaattataagaccccaccctgccttactgtgctgtaaaacaaacgtacattttactatgcattccaactgccaaattaaattaatatagacatttctttagggaaaaacattctatctttttacactagacaatcttcaccttttcacatccctgttttctttgaccttattaaaaactttttaaaatatgtatgttttctcagcagaatttaatctcagcaatgctcaatagaatttttttttttttttttttttttgaggcagagtcttactctgtcttgcccaggctggagtgcagtggcacaatcttagctcactgcaacctccacctcctgggttcaagcgattctcctgcctcagcctcctgagagagcccagctaattttttaaatttttagtagagatggggtttcaccatgttggccaggctggtctcgaactcctgacctcaaatgatccggcctcccaaagtgctgggatttcaggcatgagccatcacgcccagcccaataggatattcttaacctggggtctatggaccctgagaaattctatacaaaggtatttgtatttttttttggtatctatagcttttttttttttctttgcctccgctagcagcagggagggtattagctttgattgaatgtgtaactagaccagaggcattcccacccccacccccacccctgttcatctccagcccacaaaaaaaggttaagaacctctgctacagaaggtggtggtgaggatcatttaactttgtagatacctggtatagcactgagagtaaaaggaggagcaatggagaggggaggtcccgcagagctggagaccctaaaagctgaacctctaacaagctctgtaatcttaggcaagcaaattaacctctctaagccttaactgtaaaaattaggataatgatagttctgtactcagaaggaagttgtgagcattaaacaagatgattcctgtcaagttcttagcatagtgcctggcacagggatgcatcataaatataaaattctttagctgtcagcatcaatttcttctccatcattcctcacatatgttggagtgcacagtactatgtagacgctgctttcctgtctttaagacggatccgaatgcttgcctttcgcagatgaagatgtatgttgcagaggtggatgctgtaaaaatgggactagattagaagccctttctgtaaccttgactgaagaaaatacaaggtgacattgtttaaaggctctatcacttgcctttgtctagggctgctgttctcttctgcacatagtttgcggtcatgagtgtggcctttttactcctaaaatggcacaatgtgtcttcaaatctcaacagatgcattgtatttcaactctatcatgaaaggtagcttttgccattttttcctttttgtcaccaccatcatccatttttacttactgcatgtcccactgttccaactctttaaaaatgagagggatgatgccaatcctccacatgttagactgtaaaacacatctccttccacctttttctgtgttccttgttccctggacacatcagtatatgggcttgttctcacaagagtccactgagatgtaaatgttaatttaggaactgtattattgtttctccccaaaaaggttgctgatgtgctattccagtgtgtactaaatcactttttgcctcattattttaaagtttaaataaatgaatgtattaaatagtcttagtgtaagagtgcgttttcagtcaccataagcataatagccttaaaagtgctgttgtgttctatgacactgtgatactatttgtagcttttatccaaagatggtaagctcagtgcctcaggacttgaagcaggcagcccctaagcaactgttttttgtgtgagctgtgagtcccaggatacaagcctctcatcttcaaggtccccaaagagcagcacagctggtagctgtggatttttaggctgccctcctgtaaggtaaatggtcttttccacccactcccttgttgatagagtgccttgagagaaaatgaagacactagagtgctggtctcagactgcgctgaggcatcgcctgttctgtaagaaaaagcaaatgaagattcatgtgtattacaactgtttctcctttggaatcacaggccttttttaaatagagggggaggaggggatagtcctagacctgaaaagattccttcttgtaatataaggagagctgtgagctgtggatcaaaatgaagaggagtgaggggagtatgcagcgttgcctgtggctccagctgagctgggagccggcggcttttcctgggaactgtatgtggtgcagcaccttgggacagcagtgtctcttagtgtcttccacacgcccccctgggaaataggctttctttgcagacagggactttcccatttaagtcagctaacttttctctaagatgaatcgttttcattctgggaagcatgttggtagatgtcataccaggaaaataaccatttcagtcggctgtaattttgccttttggctatacacattgagcataattatttagggtcttcatctttttcctttcattgtccattctttcattttgtttttttactactgctacaaccaccaccactgccaccatcatcttcttgcaaatggctaagcagtgtctgcattattctaccttcacccagtaaactgagtagaatagatcttctgagccctgttcagaagcagctaaaaccgggacttgcccaggatctgtcagctcttaaatagtaagactggaaatcataccagatctccagtactctttctactgcccaatgaaactcccttcttccccttcactccctcttgccagcttagcctacctaggaagtaaagaaggcataatacaaatgaaaatcatggcctttattattcatctggttatgctagtacttggtgtggtgactcctttgcaggattattttaaagaatggtggcagctatgttttactcactttagaagtcaaagactcacggtaaatcttagcagaggcaaataaaaacatgataccaaaacctaacatctaaatctgtactgtccagtatgatagctgttagctacatgtggctatttgaatttaaatgcaagttgattaaaatgaaataaaatgtaaaaggtagttattagtcacaatcatatttcaagtgctgaatagccacatacgccctgagatactgaatttttaatttaattataatttattcacatttaaatgtaaacaggcacatgtacctagtagccactttaatggactgtgtagatacagaacatgtctatcactgaagacagttctattgggtggtgctgatctaagggctatatcaataacactgtggtctcctggcaagttgtaccctctctgtacaggggaggacaacacaaatacttcatgagctttgtcttccagtgaccttctcagctcataaacagcatggctttgcttttaaaaaaaaaaaaaaaatctacccatgtgactgcagtaatccgcagccagtaaacagcagggtgggagggttgcgaggagaactgatctatttttatgcactgcagagtccaagcaggaaaacctgagaccggagacagtggtgacatcaagactcacttcctagtgagtttattcatgactcaggccatgtgcatatttccacttggattcctcacaagtgcaagtttctcttctaggctacaggtatctgcagccaggtgctgtaatggatttatagtagcccgccaaaagatcaaatatctgaagcctgacgggtcacaaagctgacaggagccatgactattgcatgaattccagatttcacagtgaaacagagctgctgctgaaaaatgggagcacagagctgttcactggggctcttgattctagacactcaaagaggggtacagttctctgccccatgtgtgtttctcacccaaccttttcatggtgttgaggaggggaagggacagctcagtggtgattcttcacttctcaaacgtgtcctcctcctctgtcttcataatgacctcctgaagtccaaagtgccttccaaaatagctcttggaaagaggtggcagtttcctgactccccaatctcccccatcctgggagatgtgttgatggcactaatttgcggggtagcagagactatagtcctactctctttactggctggggcattggaggcatgcagtaactgttgactaccactgctacaactgctgttatgattattaccattataatgattaatcactcacaccgaatgggaagggaagtaaccttcagaggttcactcttagtacttctggcacatatgcttagggccagggccagtgagtcttcattcgcagagaggtggtagtgaatctcccacaaggatccctacttcgggaagcctgtgttcctggtggaagtcccatcatatccctcaggcatactgagattctcttctctagaattaccaggccttttctgtcactcctcaggcataccccccgtagctggagggatttccagttgccagggttctttggtgcttttctttgcctcctgcagagatgctgagctgtggacaccttcagaaagaccagcactgcctcatgagagtatctcctgtccctctttgcgggtttaggttccttgtgtagtctgcacatccagaggggatgtgtcattctctctctaccattataacctggggtggcctcgggcattcatcgtttatatgccaggaattgctaacctaagctctgctatttgaaggcttaaagactgcagatcaaaagtagacacagagggcctttacaatgagatgataggccagtagctgtcattctttattcttagtgctcatctaagccatgaccatgtccttcagatgtagcttttagatacttttcatgtgaaagactggatacctctagtcgacatgtcagggccccaaaggaatcaagtccctttggcataccttcatgtcctcttttttttgtttttctgtacttcaatagatgcaaattcatttactctttggtctgcctgtgttgggtattctcagcttggggaaactcaatgagccagcacaccatcctatgaacagaacaccaatctgagccagggacattccgagcagacaactcaggtcagggcttccggacagattcccaaggtccctgccatctggcagatggacaccactgactgtggtctcctctccatccacggtgtcctcaaggccaagttacatgcttctttgtctcattctccttccctttaggtccgcagatctttcggagtctttgtatgtaaaggcagattttggtcttagattattccagctccttataaaccaagactgaatcttgtgcctgtcattgtgagcgctattctgtaaagggatttttttttctggcataccaaatccagagccataattggacaagtttaattggagtcatttctattcaatacatggatggcaaagtgggttttaattgagcatgtaaaaagggcattaatcactgttcacacaggaatcacaatattagaacaggaaaaattcttataaagtttttcaggttcttgggtaaaggggactttcctctttttatttatgcttccattaggattttgaaggaatgccagtgcactgttattaactctaatagcttgtccctcgcagccaggatggtttggggccctctggctctcaggttacctgtgtaaatacagggattcacttgccagcacccagctctgacatttgcttaataaagagcaaatgtgcagaacccaacagcagcagcagcctggcagaagcagtaatctgaacaggataaacatgcttcctctttgtgcgatgctctttctccatccttctgccaagagcaggatatcaaatgaaggggaggttgtggttggagtcagtgaagtgaatgtctaagtggcacctgcttcattcaacagatctgctttcctggggcctcccagtgcacatctgctcctgacaaagcctcttttctcctcctattggtcagactgagagcaaaggcctggcaaggagacatactggttttgctttgtcagcacaattgcctgtgacattataattacaccaaatcttcattattagaaaggccccaatttagagattttcagagcctaaatgggattttctaagtgaaattgattaaaaaaaaaaaaaaaaacaaaaaactttgccatcataaagcctagcaattgcatctgagaatcattgaaggggtctaaatatggaaaccgagacactgctgtgagtgagactacaaagaccatgctatcagattggctcgctagagaggcgtccagcagtcttccgactctgcccagcccatcctctccttattcccgtagcactgtaacatgcagatacctacactgcattgctctcacatgctgatagtttctcatgcagaggcctggtgggggaggggctggagggtgttaaaataagttgatgaggtatggcagtaaaggaaagaacctgtgacttaaataagggaaataccagaaatctatattttaggtgaatacaaagcatccaatttagattgagtttccatttaaacaaaggcaactcttaagagtgttgcacagtgtgagtgtatgtgtctgtctgtcggaggcacgtttatgatatggagttggcacactggaagctctggaaaggttttagagctgtgctctggctatttaaacttaattaaaacagaataaaatttaaaaatcagttcctcagtcacgctggccacatttcaagcactctgtagccactgtgtcggacagcactcaaacagaacgtgcccatcatcacaggaagctccagtggaccacactgtttgaggttggtctgaacctcttgaaatgcctcggctgcttaaggaagcctgggagtttctattgcaggcttgttggaaggaaaaaatgaaatttgcctcaatgtttctggaacaactccttccagccatgttacctagactgtgttctttttcacctttttgtatttttttctccaaggatttcatgtcctttgcctactcctaccccttgtttaaaaaaaaaaaaaaacctgaattataacaatgaaaaggaaatttaattttaggaatgtccactttcagctgaccttctccttggccttctcctaattaaactttcacagccctgctgttggaccagacagtccttttctcattaaatggagcaccttagtaaaacaagagggcatgtgaacactcgggccaagagtgtgtaaacaagttgtgcattgtgtggacaatgctgctgggtgtggaacgctgggctgccaacactttccattttcagcaactcttgggaccaaggacagggcctttaatcttgcttcttccatttgtctgtgtctagtagctactacacagttgctttgactcctggagaaagcccacgtaaaataacaatactacttcaaatttagacagtgtctttttttctcaagaacttaaatcatgtaagcatgatgttatttatcctcatagtggtcctaagatacagaagtggcctgttggttttacaaatgtgaatatagtcaactcttacttgttacctacagattatctgtcacgcagattactcgtgacacattttaaatccttgggcaatttctctgagcgagccagtgtaagcctggaccatctcctctgccccccgacccagctgctgggtacttagggaatacaaattagttttcatattagcttaaagaagacataattaggaaggtaagtctgctacaagaaaatcacatcacaaattccaacggcgagggggaaatatgagggaaatgacctcctctcccttcaactgaactaagatctggtggtctaagtgcacattagcacttggtgctggcatgcttgccgaaggctttcctcacgggtggaaggagcgaggctgtgcaccctgcaccagatgtgcatgggaggctgcaagcgccgcagcggggctggtggcccatcttgcccggtgcttttttttttttttttttttaacagttctgtgttattgtcaggcctctttatggcagatcgtgcaggtcgcaagtggatcctgactgacaaagccacaggtgggttcatctttggggaaagaaggaagcagctggaggatagagtcactgtgaggctgtcattccaggcgctgcttcctgcttggatggtgggattcctctactgtgcagtccccctcactcggtcacctgatagttttagtaaccattgattccattgattatctgatttttctagtgttaaatgtttccttttcatttattagctggaattcttttttaagagacagggtcttactacattacccaggctggagtgcagtggctattcccagactacaggttcgaactgctggcctcaagtgatcctcccacctctagttgggattcttttataaagaacttgtccccattaacaatttggctatgctaagtacagttcagataggaaaagcaggagaaaaacttgatgaagatgaactttattgggatagagttctttccatcttactctaaagccccattactgtctatttccacttactgatctgcttttttcaggtgtctcactgcctagagcaaatttaattctgccctttatgtgctcttaaaaagttttagtttttttgtggtttttttcctaaatggtgctctacagattatgctgagtgaggggatgaaaagtcacgagtacatctttggaagcttccttgcctcagcgtatccctgctcagatagaagaggcagggactggatgacaggcacatgggggttcattgtactcctccctctcctggtgcctatttgacattttccatcataaaaagtttgaagaaaaaaaaaagtttgaaagtaataataacagaaaaataaataaatctcccttcctaactctgagtaactcctgagtgggcctgctgttcatttctgcacctgactgttgcaggctcctggtgactttcttcttctgaggtttgtcatctgggctccactttccattttaaaatattggtgcactctgcatattgccatgatctatcctctgggacacagacttcaacctgagtgttgttcccacccttcttcctagtgatttcttctgggaatttactgggtaccccttgccttgctctgtacagtcagatcagatgtcctccagagcaggggtccccagtccctggcacggcaggaggtgggtggcaggtgagcaagcatcaccgcccgagctccacctactgtcagatcatcagcggcatcagattctcataggagcacgaacctattgtgaactgatgatctaaggtggaatagtttcatccccaaaccatccccctcaaccccccccccatccatggaaatactgtcttccatgaaactagtccctgctgccaaaaatgctcgggaccgctgctccagagcacgtgcatattccacaagcttcagcagaacgctttctctcctgccattttcagtttaaagccttcttggcagggtcaacaggccttgcagttagcttgttcatccccacgttgggagctcaattttcaggataataaaccatggtggttctgaatactgaaacacagagcgtttcataacgctcctgggcattgccagtaatttcaagaggaaatcatgacattgtatctccaaaataggtcttgagatatatttactaataaagtaaaaatgaattcagttttaatatttggcttatgggatgaggggcatgaaaagcttcctggtggtctgcaaaagcaggcaaaagatagagtgagcctgtctcaaccagagtcactcctttgaatgttattccagaaagcagtttttcttagtcttgagatggtccagcaagagagaagaaaactctttgagtgctgaaaagcaccctgtgcaccaaggcacctgtgaggctgctcttggcttcatgagaatattcagtacttgccagatgtaagacatattttaatccataaatcccccaaatgtacccaaaagcttggacttaggaaacacggaaaagggagattaaatgtcccaaaagcagctaatagaacagaaacagaaccactgggaaagaaatgctttttctcttccccgtttgccctactatcatgaggttacttggacctcctttttgtttgatattgacattctcttcatgaccttcctcttcttgccctacatatgtcctctttccatctagtccttggtattctcagcctgtctaactgctgtctgcctgctagactagcttctttactgatttcctgttatcttcttccacttctatactggcacataccatgcctgtttttcttcatatagtggctttccttagacgtcagccactgatgtaaatatttttccaggcctgtaaatggaagatttttaaaggacttccttcctgcctgtcacccctagaaacacctatagataccgttgctggctccttaaaaactcaagcaatataatccggaatttaatttcttactcacgtattcctctcctttctaatcatggtcccggttcccatttgggccagtatttctttgatgtacatggttagcgttcatgttcataaactaaagaaggcattacgtaatgtaaatttccctttgggttttaagaattatttcttttccacctactgtcatgtttattatttgtttagctctctctttttctctcaacagccatcaatatttttctcccaactaaagatatttccatgaccaccttggaaggccttcaggctgaaagattcagttacagcaaacaacaattcccaaaggtttcccagactgtgagggcaaatgaaaggcccattcttcctcaggttgtctgtcctgctctatcttgtcgtggggtgaggggaggagggccagctatggtgctggataacttcaacagccctgcagccctgtgctctgcctggctcaagtctgttagtttctggaggacttcagaaatgtatcagggtgatgacatcacatcatactgccctgattgtatttttcacattcttaatattgaggagtggttctgcctggttgcttattgaccagtgcactcgattagcaaccacttcatctacgtcatgtgcagtgccagttctgaccatcactgtgtttcagaagggaagctgcctgccagtccatctgccctgatttcatggctgttatctttaatctttacatctttgaaggcctttggtgaatgatgtgcttcctggcaggagaaaatcactgctgaaaggagatctgtgttgtctctgcttttctttctgtttcccgagagctttagtctaacatctgtgaccccagccagactccatcaaacttcatactcaaagtcatctttgaaaagcagtggcatttattatatacctactatgtgccaagcactgtaatagattttaatgtgtcatcccatctatctagtttagcagccctgtgagatgagtgatcaccattttacatatgaggaaacaggctcacaagccattaaacagcagaaccaagattcacatgtaggtctttctgactgggaagcctttaatggaaataaacagcctactttttctcacataaaatgcacctgatctgcagcaccatgagaatggttgtggagaaaattcgacttcattctgaatcagagtaaaaggtgttaaggctgtttggtctgtggagggcaagactaaagggactaccatcaagtttctgaaattcatgaagagtatgatcaatgatacattttcatatcatattcaattattgagcacctactgtgttcaagttgctcaacattaaaagacagtcctcggccgggcgcggtggctcatgcctataatcccagcactttgggaggccgaggcaggtgaatcacgaggtcaggagttcaagaccagcctgactaacatggtgaaacccccacctctactaaaaatacaaaaattagccgggcgtggtggtgcgcgcctgtaatcccagctactcaggaggctgaggcaggagaatcacttgaacctgggaggcagaggctgcagtgagccgagatcaggccactgcactccagcctgagcaacaaagcaagactccgtctcaaaaaaaaaaaaaaaaaaaaaagacagtcttgccaacaatgcaagcatgcagatttatagacagaaaagcagcaactccttgggaacaggtcagcacatacctggggccaaatgaatggtggcggcaataaagtcacaggagggagaaaccaggtgggctgtcccctcagaggcaaccccatgaaccatgtggaaactgctagaagaactggcctgagactggcagggcctaattccagacagagagacctgcctgaggaagttcacatggcatccaagggacacatgtgattgtaatgaggggatagtgtagggtgttagcaggaaaggctacataaactccttcaactattagctatttagactttattttcctgataggagaaagcaaagtaatgtttttgatgggatgggatggcttttgccaaacaatattttaagatgttaaccatgataaacatacttattcatccaataatactgaatactgaaagaagttagccttgggaaaaataaagtccctcaaaataactaaataaattccatttccacggatacatgcacatatgtttatgtgtgtaaatttcattacacaataggcaagtgatgaaactcattgccccaggagagatctggaatagagtagattggctcatgaatgataaatccagagtgtgcaagactgtgaccctaacctttaaagcaaatctcactggtgcccgtggtctaccacagtgctcccctggtgccaccatcagagacagaccactgtaaaacctcatggccccttgttttgcagcgtgcaaggccaggcttatgaatagatatcatcatctgccacccatgtaatgtgatctgagaggcatcactttgtacggaagttttaaaagatccctctggcaggcgctaaagtagggttattacaaaggaaggcaagagatggtagtgtctgtccagggaggcagggggaaaagtgttgaatttgggttctgtatttgaagggagagaatcagctggtgcattggatgtgtgaagtaaaggatgacttcagagcttttggcctgagcaactagaagaatgttattgccatttatttgggaagagaggagacttgggaaaagcatgtttcaccattttggctcaagaatgatacacattaaaaaaaaaaaaaaatagagccatgtcaggcctcattgtccttgacagggaaacatggtcctgcagccagttcttccagagatttgggtccaactgctgcttgacgaggaaatctttatgttggcacctgaagtttctgagtcacctttgactttttttccattttgaccaattctataaaccttaccatgaagcttgagaagaaaagcagcagggggcccaaagaggacagtcctctcccttctggatccttcctggccctggtgttaagtgtttaaggacattctaatatatggaaaaagactcccaaatcaaaggcctgggtccctgactttaccatcaactcagtcatttggggaacaaaatcagtcctcctttgatctgtgttgaggtttttttttttaataaaatttttatgtttacttttgagttcaaataaaaagacgggttgtatttactaaactgagttaactccaaggttgtgtgtagctctgaaatactaaagtcttcaggacattagaagtatgtgcctttatgatgagcccgtggttctggctctgactcgtgaaagggaaggagccctgccctgtggacttctctagggtctcagcagaagtcaagtgacatgcagcgggggtgagagggctcagaaaggggctgtactgaggccaagggtctcattaccaggactctacaagggccctgtaagaaaaaggagcacttccaccccttaaagtagaacacgaagggcttcctgttgcttaatcaatcgaaatgacccagaatacaagcttggattaacatgcgcctctagattagggctaatcaggggcaggctgagcagatgcagggacagtcccagcctgattactgtacctcagcatttaatcatctctcttccaagggcagccgcccgacttagggcacgctgggtttccaggcctccagcccctccccctttcccttgccagggacatgaaggctgttaggtcagagacactgaggcgatttaatctaatcccatgtcaaaatggctgtgtgtgagagagacagaggtcttaaaatccctacagtggtcatgcatttatttaaggtggcagtagacagaaactctatgtagaaaacagcggaattggggttccaaggcatgcgaggttatgaaatgactcccatcatggcctccctctcctgtgcttctaaggtgtgtggctgtcctcaccagttactcatccctgggagctttgggtggggaccatttcctcacccaggtgtggccaaatatgcttcttccctgtctggggtggagtacagaagatggaatctttcaaaaacagctttatttgggtgagtcttgaatatagtatttttgaagctgctttttttctgggctggaagctcttgttccagaacagcctcatcaccctaaggctcacccaccttaatcacgcagtccctagaagggacacaagttaaatcttagtaagcaggtttcattcatggtagtagaaaacattccagcacctgctgactgctggccactcaaagatggagacttaattcctcccttaaggaatctacggtctccttggggacaagacatacgagcagtgaggatgaatgaggccgctgtctccaaggagcctgtacagggagcagaggaggagcatcggagaagaggacccaagatggggaggagagaggctggggaggagccccctccaggcagaaggcatggaggtgtgtgcttggagaacctcagtcaagtagttcatctggctggcgtgtgaagtgagtggggattagtggatcaccaggcttaactgaacaacagtggccgacgtgaagagtttaaatacctgcaaaggggtttggactttatatcccgtgggccactagaaaccactgaagaactgtgaaggagaacagcaagatcaggtcagatgttcagaagatcattctgatgatggcagtatcagccaatagatagatttttgcattagaaccttgcttcatttattctggggaaaatcttccgtgatactatgaaaactattttaacaattgggcatgggcccacatcataggaaacccaaacacatcacagccagggtgaaagaaatttaactttgacaattcttttagtttctattcacaccagccctaacccagatggttgctcacagttagttagaaaagatctccctgcacactgtagtcactgtatttgtacagcaagggacttgttccccaagcctggagcttttggaactgaatggagcccagaggcaagagcagtgaaatgaggctgacctttgcttctggttttgcttgctacttgccagtatgtgggttccctggaggaacacacaggtgtcttggctttgccactgggcattttgggtgatttcgttaactttgcctgttttgaccagaagagagcctgatcgtgataggaggaggcgggggactgacggggttatacaatcttcacatatatatacactcagtcccatgccttgagtctagaggctggggagagggcccagctgcacgttggttgaggccagcagtacatggcccttgaggctatgctgatagcaacttgtggcacactttgtacttcatactgtgaggaacatgaaataagccagagccaggcctgatcttgaaagaaccctctgtcaagtgggaaggcctgttgcagacatgcatcaactggcccagctggcttatccatggctgtccctgggcctcctgtgaatccagaggaggctgctccagcattgataaggctgggatggggcaggttccacaaggagggaaagctcaccccagtgtaaaaggaaggagtgggggataagtctatctcatgaataacctgagcaaaggcccaaaagagtgtggctgatagattgggggaactgagagtagtctgggggtggggggcacctagaggacagggcacctgtgagagagtgagggagatgagactggaaagatggaccagggcaaaccacgaaaggccttgaagaccatgctaaatcatttgaactttgttacaagctttggaaaccttttaaaaaccatggaatttaaatgtttgagatgaggggagtaacattatggaaagatattttggctgggtgtggtagctcatgcctgtaatcctagcactttggaaagccgaggcaggaggatcacttgagctcaggagttcaagaccaacctgggcaacatagtgagacctcgtcactatttaaaaaaataaaaaataaataataataaagaaagataatttgagtgactgggaaggggtgaactgaaagagagattaattaaagacagttaagagcaatttgcaaaggtttagttgaaagaaattgaagcccacagttttgtaggccaaggcctggcccttctgcgtgcttcccccatgcccacgtgcacttggaggctggcctctctcctcctcctttcaggcctgcattgcaagtgtgggggcgactggccacgtcttccatttcggtgagggcacaccagaggagccagggtttctagtgatgcgtcaccataacagcaagtctcatttcatgaagtctcactgcatcatcaaatgcttaccccttatccctaaactggcaaaacttactcttagaaaaaagttacatacaatttaacattggaaaagaaaatcttatatttgattttttttgcattagaaaatattttgacaaccctttttaaaataatttttatcttcatcaaagtagcctatggtttaaatgtcaaaaagaactaaaaggggcctctctgggtcagtttctcaatacagtgggtgaacctcagaggcccagtcagcaaaggtctttgggtctggatgttggggttggtctaatcaattaaattcaaactttccactcattctcatttttagcctcatccctctttctgccgtagctaggcctctatgtgctgagccctgtgtgagcataggagttgccccttccacttctctgttcaatcagaaccatttcacatttgctttgcatcttcccaaaaaatgttgacatccctcggttatatccttttttcctcattcactgtaattctagtttcagaaggaagagagattgatgtatatgttagttactgccttactgggaatccttttttttaatgtattatcagctttccctttttaggcaggactacctttatggaggttatgtgcttcttcctttaagccatcctttctactctgaaataatagtgatattagggagtagctggggtcttttttttttaagttgaccccaaaatgtgtttttacattttactggtgtgtgaaatctagaaatcaggaaacaagtgacctaggctttaaaaataaataaataaataaaataagcttgactatgaaggaaggcacatagacggagcagtggccagaagacaggataggagagggacaagatttttcttttcaagctgagagagacttaagcataggcagaaagagggttgaagaaggcagtgtagccaaatatcaaagaaaaataatggtggcctgttctgagagggagaagacaggccggggacattcacacctgacgggcctgtgcttcctagatgcggaggcaggcagggccctctcacggcaagctgggaaggccctaccctaaggcatgtttccacaatttctctaaacttttcttttctgatagtctgttttaaaaaaatcaaaatggtcagggttggtggttcacgcctgtaatcccagctattcaggaggccaaggtgggaggatcacttgaggccacgagttcaagaccagcctgggcaacacagcaagactccatctcaaaaaaaaaaaaaattatattagccaggcatggtggcacacgcctgtggttccagctactcaggagaccgaggtgagaggatcacttgaatccaggagttcgaggttgcagtgagctgtggtcacgccactgcactccagcctaggctacagagccagaccctgtctcttaaaaaaaaaaaaaaaaaaagttaaaatggaaaaaagttgatttcctagaagtagagagtagaataatagttaccagagtctggggaagggttggggaggggggcaggagaggttggccagcaggtgcaaaggaagaataagttctggtgttcagttacacagtagggtgactgtagcgaataacaatgtagtctgtgtttcaagatagctagattttgaatgttgtcaccacaatgaatgataaatctttaaagagattaatatggtaattttcttgatttgatcattctacagtgtatacatgcattgaaacatcacattgtaccccataaacatgaacagttactatatatcaattataaatcttaaaaattaatgaaaaaaattttaatggggtgggaaagagatgtctttgtgcctgggccatgggtatgtgatcacctgaggctggtgaccacgatacctcaaaggcaagacttgggtgcccccgtccagccagcatctgggaacttgagcctgagccccaccaacggtcttctctttgtctctccaggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacaggaagtggaattgttcatctctataggagctcttggcttcttaggcaaaaggaactctatcttggggcagctcgttctgcgtttaaaatgcagtcctactcgagatcagcggtctccgacctgtgccactccgacgctggggacctccgtaaagaagacactgaagattgcccagagccccctgcgagccccatcaccagacctgctccatttcatacatttcatatataacgtgttttcttatactgacgttctggggaaaaaatcgtatttaaaaaatcctaggccgggcacagtggctcccgcctgtaatcccagcactttgggaggccaaggtgagtggatcacttgaggtcaggagttccagaccagcctggccaacatggtgaaaccttgtctctactaaaaatagaaaaattagctgggcatggtggcgggcgcctgtaatcccagctattcaggaggctgaggcaggagaatcgcttgaacccaggaggcggaagttgcagtgagctgagatcacaccactgcactccaacctgggcaacagagcgagactccatctcaaaaaaaaaataaaaataaaaaatgagggtgagtgatggtgcctctccatcttgggaattactattaaagtgaattgtctttctttctccaagcagaagcctcaagccatgacttgttcccctgcatcctcactccctggtttctcacacagcttactctcttaacatggcatatgccatcgctccagctgttcctcctgccccatccttaggcccttcatagaccccagtagcctgcacctccatgcttctgcatgccctggcctcagcctggaatgacctgctgtcacccccaccaccctttctttatattgttgggtgtcttggccactttcctggtgaccatgattagaatgcttgcttggatgggaaggccaagaagccttttccttgatgcctgatggtggttcagtgaagccaagtgcctacctttcccccttcttgcacaaatggcataccctcgcctatttttcaccagagactggactagaaaaaggattgagtgcagccaaatcaaccacacatccgtgctattgactaccatgaaatagctgggttgtttagaatacctgctgaccaagggtctctccagaggcgtcttctagctgctgtttgcctggcaagcctcagatgctgcctttgccacaggcatgtattgacaactggttttggtggggccgatggagacctcttccattcctgcctaagtcaccaacaggagctgctaactccgctgtctatagagaccagggaggtcaaatcaatgaaggaagctgaggcaattcccatgtgagaggagggagtgatggggacaggcacagtggacagcatccatctaaacggggcagcctgtcctaggtgctgattgtcaccatgcaggaagatggaccctaatgccccaacttcaaaattgtccagagaatctggggaatccagatttttgtacgagatgtgatcgcaacaaataaaaaatttacatactctgcaagcaaaataaaacccatctgtagaccagacctgacctgacggtcagttgcacttaactacgtgaatgcttgtcatgtgccaggtgaatgaagcatggtagttgcctgtgagaaacaaggagtgaggaggagacctttacataaaccaaccgctgcagtccaaggtgatgaggcaccatctggacagagcactagtgcagaatgagctgtttaccgcatttgagccctcaaaggtcctctgttacgtagtttatcatctaggctccacacaaggatctggtgctcacagaaaccaggagactggtctaaaagttactggctttaagtcttgcatctgagaaggcccactggtgatacaggtgactactggcattctccaaacttgaacaaattagctgaggagaaccagaagggcagagcagaggaggggttccttgccctgggcctcactcacgcccaaggaacgctctctccccctctcagtaatgcctccgaagcttgagctctgggcatggcagagtcgtaccgggctcctggtgtttccttttggtgtcagcaccaaaactcatcagggaggaaactggagcttaattatttggagcagaagctacgtggggtgagggagtagagtccgtgttttccctctcactccacctcagcaggctggtggcaccttggtcatcacaactggggcttcagatgccccatccctgcactcccacccggcctctgctgtttactccaggaggcagctcttggaggtcacccaggatgctggcggcagcatggaggaaggggtacaatagagaggggaggcagggctccgggactgggctccgactgaaatcactgaagagcgtgggtttcctcttagtccccaagcccctctgaatatgagtttctccatcctgaaaaccactgggctgctaccaaacatttgttgagtattggaggcctggaatatatagtgaggaaaggaggaagaagggataacagtcatctgcagaggggaaccaaggtgccctgagaacctagagcctccttaggaggcaggaataggcctgggtcctgagccctctccagggctcaagctttgctagcttgcttacgagaactatggtttgtctacacagagtgtatggtagcaatgataacagtgaacacttagcccttacaatatgccttgtactgtattaaaagatttacctatatattaatttatttaacctttacaaaatactatcatccccgttttatagatgagcaaactgaaatacagagaggttaagttaaacaactgagccaagttcacactgctggtaagaggcagagctaaggtacaaacctgggcgggcaggctggctggtcccagaatctgtgcctagaaaaacatgacttgagcctcatcactctgtcacccaggctggagtgcagtggtgtgatctcggctcactgcaacctccacctcccgagttcaagcaattctcctgcctcagcctccctagtagctgggattacaggtgcccaccacacccagctaatttttttgtatttttagtagagatgggctttcaccctgttggccaagctggtcttgaactgacctcaagtgatccacctgcctcagcctctcttaagtgctgggattacaggtgtgagccactgcgccaggccccgatgatacacttttcttgtggcctggaatggatgaaagtggagggtataagagcattcagttggggcccggcgcagtggctcacgcctgtaatcccagcactttgggaggccaaggcgggcggatcacgaggtcaggagatcgagaccatcccggctaacacggtgaaaccccatctctgctaaaaacacaaaaaattagccgggcgtggtggcgggagcctgtagtcccagctactcaggaggctgaggcaggagaatggcgtgaacctgggaggtggagcttgcagtgagctgagatcgtgccactgcactcctgcctgggtgacagagtgagactcccatctcaaaaaaaaaaaaaaaagcattcagttattttttaagtagcttaattaatttttgggaggttctccccaaattttatgtacttggcaaataaaatttttagtgaaatttaagtttactgggtctcaactgaaacttctgaatttatctaccctttaagaagcttaatacactttaggaggccaaggcaggtgtattgcttgaacccagaagtttgagatcagcctgggcaacatggtgaaaccccatctctacaaaaaatataaaaatcagcctggtgtggtggtccatgcctatagtcccagctactcaggaggctgaggtgggaggttcgctggggcccaagaggttgagactgccatgatcatgccactgcactccagcctgggtgacagggcaagactctatccaaaaaataataagttacagctatcaattactaaatggctactagcattttactgtgtaaaacaccttacacccttatttctaatcctcttcacaatccggtaagaagagactccattttatgggggtggaaactgagacttggcatcttccccaagaactaaaaactggagggctgaaataaggcctgatgtgtctgtctgttacagctctgctctctatgccaaccattcagaggacaaaactgcacatcaggattataaagtaacctccactgtgtcctgagcttgatagacctggaatagcctcccgtggctggacctttttaccgctccccaccccccccacacacacgcgtgcccttacatgcagcagggcctcaatacatctcataggatgagtgaacctagttttccagtggtagtttaatcagaaaattcagagaacccaaaacacctattcccacacattttcattactcaaaaaagtctggccagcatggtggctcacacctgttatcccacgactttgggagaccaggacaggaggatagctttagggccaggagttcgagaccagcctgggtgacagagcaacaccagtctctacaaaaaaaaaaaaaaatatatatatatatatatatatatatatatttctgcaaaaatccaatgttaaataattttatgtaaaaataacattgattgtattcttaagaaaaatctggctatgtgatatcctggcaggggtgacggatagtgaaatgttgatgctgaacacattcttggtcactaacagttgcactgtgttggtctttaaaaacctcagggcccaatgagactaggagaactcaaaaacccctgggtgatcaggaaacgaagccaaagcttggccctctcatagtggactttaatctgcgagggaagttagccaccactcctcatttgggctatgaaagttgaagccccgggtcacatggctggctcatcccccaaatcactctgctccctttcctactcagctcctcctgcccgggttaccatccagattctcaaaatctgaaatttttaatttagaagttaggtatttcctttaccagagctatttttatagaaagcaagagcaacgtttacaccaaataaattaatgtgtaattctggaatttaccaaaatggttgcagaaaacaaccatgaagatagaccttttttttttttttttttttttaaatacagtaatgttttttaagttagccgaagttcggggtaactcatcacataataggattctctaacctgggcctctgggtactcatctgtccaaaacagcggtcaaacgacaaggacgatgaagacttcgtgggccctgctgaggtccttgggagcagggcattcgtgcggggctgtggggcacggccgagctgagggtccctggcccaggggcctcccgtccatgccgacgcccactcctcccgtaggacccagccagtgcgggccctgtcttctagcccagcctgaacgccacgatgcagggaagcgcctgaggcctgccggggctcaacacctgcccgactgtgagcgcggaagcccgcagatggcctgggcgaaggcggcccgggtgcgggagacgcgacgcggggtcactcagagcccgagcgcatcccgaacccagagccgccgtcgggggcgcacccgattggccggctgagaccacgtgtccacctgcggcccaatcagcgatggcaggacatccggaaggcctggtccagaccgcagggtatgggccgctctcgggggaagcgagctgggaaaagcaacccccgagtgccagtggccgcctttatgtgccagggtgctgcagccggggaatgatggcgcgggcatccccggcttccccacgggccatactgcctatctgggtctgtggaggcctgccttagtaaattaggggtcatttgggtagctgtgtgccgtctccgcctcccaccatccccagtagcctcaagaattttttcaaatcgttttattgagataatttatataccattaagttcatccgtttaaagcgtaccattgaacgatctttagtatatttacaaagttgggcaaccatcaccataatctaactttgaaatattttcatgatcccaaaaagcaggggttttttacacatttccctacaaaataacttgaagtaagttacataaaagatatatacaataaagttgaaaagcaaatagaaatgaggattcaaagaccaacggaagcaggtcacatttgtcagcctggggtcaacgtcggcggtgtgatgaaggtgcccttttagctctggtcttggctaagaggttggaattactagaaagggaacaagacacagttactcgaagaaacaaagcactaagtacttttttttttaagtttaagagaacgccaagttattttatattcagcatctttcacaacatttttatagccaaagaaatagctttatttccttagaccttaaaacctcaattttgaaagtttcctgggaggggccaaactaatgtggcatttcagtgtttatttacagagcattaaggaaaggatggaggggagacgggtatggtgaactggccatctgaaatggctgcttgagcaaggaatggcgtgtgactttttccatttcctgggatggatgatcagagccacaactgtggacacagagttctccccatattggaaccccacattctcaagagaaccgccaaccacgggagcacaaggatacaacgggctcagctgcccctggccaccaccccagtggtcccgccatgggccatctaagatctgcaaagatgggtggagctattagagtcgcaggtctgggggaaagtgcttaaggatttctgccttccctttcccatcctccctccttgcccacccctctatcccccacccaaacccccaccccctgcttctggaggatctggaccatgagcagagaagggaagtgtctaccaggaagaccacgttcccaacaccgaggtcctgcctcccctcaggaaaagggcagcacatgtacttgaactcaagtttgagactgaagcttgaaagtgataggttgaatgatggtacatgcttacacagatacagaattcacccaaaatgtcattaaggagctagaatgggccgggcacagtggctcacgcctgtaatcccagcactttgggaggccaaggcaggtggatcactactcaggaggctgaggcaggagaatcatttgaacctgggaggcagaggttgcagtgagctgagatcccgccactgcactccagcctgagtgacagagcgagactccatctcaaaaaaaaaaaaaggagctagaagggaaagtcaacagaacaaggtcaaacaaggtcaaggcagtgaccatagaaaataaaaccatgttgtgtccagatccaccaaatcaagaagcctgatgcctttggttccatgaacagaagacacctcagacttgtgggttagtcagtggcaaggaaaggttccatttccacccaaccctaagagacacaaatccgttttcataaaagtgtgagccccaccctgccccaaggatatgggggatgggcacctctgcctgtggctcacctcccctgacaagctccagtgggtgctgtgcttcctcttcactgggaggcttgttcaggaaatccagttcactccattattgaaaacaactccatctccaggaaaagttgaaactggcagttttagcatctgatgatggagccttctctgccacttcaaggcctgctgcctccttttccagccggcctctcaccccaggaaacaccagcgaagccagtgcaaggagaggcctcaatccctggaagattgaggtcatgcctgggccaacacgtgtagcagagcttggagaaccctccctacaggacttgcccacctcccactacaggggctgactgttcagcttctgctctttgagaaaagacacatccactgtgaatgcaaaactcttcgtgttcagttttctcatcacagcatttatacttttttttttgaaatggagtctcgctttgtcacccaggctggagtgcagtggtgcgatcttggctcaccgcaacctccacctcctgggttcaagtgattctcctgcctcagcctccggagtagctggggtcacaggtgcccaccaccacgcctagctaatttttgtatttttagtagagacggggtttcaccatattggccaggctggtcttgaactcctgaccttgcgatctgcctgcctcagcctcccaattatatacatttttaaatgcctagattatggctggggaatttagggagttgtgagaggccccaacttgggtgaggaaccagcctcgacataaacttaggattgtcatgctgacagggcatctgatctggtccccacctgaggttggcatcccactccagcacctttgcttggccatctccagagatggagggtccagacccgaggccctcattggtgcagtcaggaagctctgtgtgatgtatagaacatgcctgtctggggtcggctactgcccctgcttctgctctcttaagtcatagagaactagaattctttcaactacttgaaaataacctcacattaccacccaaatctttcatagctaaaatctccagtttccatttttcctggagatgggtgagttgtttccagaaatggagtgaactggaatttcctgagtggcccccaacgaaaaccaaaaatcctggattttatgttttgaaacgtcttccaatgcacagcaatatagcgagtaagccacagaagggacctggatagccagaccatctctggtctggtccagcgcacaccacagcacgggtgccctccaaactgagcccagactgagggataacgtcaagggcttcacaaccttcatctcccatgattctcctccaggaatctgctgctgtaagttggctgcagcctgtccttccaagcaccacactttgcccctgtattcctccccctgggacctgctctttcccccttctctctctactcaggctcaatgtaggtggctccctccactcagagcccatgcaccaccccagccctggaggccatgcctttcttcagccccagcacctcttcctgtctgtactacatgcacctgccccatccacactgcccagtggggcttgtaaccgtgcccagcccagctcccgcgttgagctgtgtgtaccaggagggcagacccattggcattgggtgccatgcctcctgcagcaagcccagccctttgctgttagtgtttaacaagaatcttgatgggggccgagcgcggtggctcacacctgtaacgccagcactttgggaggccgaggtgggcagatcacttgaggccaggagttcgagaccagcctggccaacatggtgaaaccccatctctactaaaaatacaaaaattagccaggcttggtgacaggcacctgtaatcccagctacttgggaggctgaggcaggagaattgcttgaacccaggaggtagaggttgcagtgaaccaagatcgtgccagcacactccagcctgggaaacagagcaacactctgtctcaaaaagaaaaaaaaagaacagctgagttcatccctaacagcctcttcccctgcaggaatgttggatgcctcttaaaaaaaaaaaatgaatattggtggacttaatgcagccatcttctttctgctggaaagctggtctttgtggaaacctctcacatgtggttttgatggtactttgtgcacacttactctgtgctccaaaaggtgcccgggctccagctgcctgacctggaggagctgccttgtggagccatctgtacgccctaggccctgacaccagggcagcccctcccttttggaggtcagagccaggcaggccttcctatgacctcagggggcccatgggctacccatgcacgagggtcccttccactgcgggaactgagactcttgggggggtgacaagactttcggagatgcttgaggtcagaggttacgcagagtgtggaagtcagaatgcatcacccaggtctggaattccacagcctccctgccacatgccaggccccataccaggccaaggccagccctgggcatgaaagtgtgagtgagatacagcctggacccaaaaagcctccacagttgatgggtgaagctgacctactaacctcaaccctcacccctagccctgtggttttagcactggcaggctgggaaggtgtgtgcagggcatttgagacatgctgccttaccagcttcgaagggaggaagagctggcggggagggcaggccacatgaggaaggcgaaacaatttcttcctggcgagcaggaagacaggtggggggagcaggagggtagtttgcatggcaaggctgggtcataccaggccccataaaccaggtaaggcgcttgggcttatcccaagggagagggtggggatactgtggtcagattagctcagaggacggtcagtggagcagggcaggacagagatggggaggtggcagtggtgacggcagctgggacattccattccgtagggaccatcccactgatcagtcctgccttcccaccaccctggttctagctctgccacccccagcaaccatgtatcctagggaaaggcagaagtctctgcaggggctaaaggggcaccagggagaaggtcagggtccactggccacagtgcagccccctcccctggctgtgtggcacggggcctgcagcctctgggagcagttgccagggcccgggttccctgctccaccactcaccttggctataaacacttcattgtcctgatcctgtttgctcatctgtgcgctgcccgtggttgtgaggattcactgaaatcatgaaaatgtagcacagtctgtgctcaaagatcaatagctttactgtgactcaatctgcccaaagcccccaatttcttcttcagcgcccaccctgctgaggccccataataattctattcctgccagcatggagcaccagcagctgtaccagccaaatgaagctatgtgggtcgggggacaaagatgatgcaaggctcctccacgccagcttggactataaaacgcattctaatcactgaccttacctccatgcttagcacttagcagtacttgggcaccgcgattatgctgctgttgatcactacactaaaccgttcagcccacatctcctggttttgttatttacaagcttaagaacagagagcaggccgggcgcagtggctcatgcctgtaatcccagcactttgggagaccaaggcgggcagatcacgaggtcaggagatcgagaccatcctggctaacacggtgaaacccccgtctctactaaaaatacaaaaaattagccaggcgtggtggtgggcgcctgtagtcccagctactcaggaggctgaagcaggacaatggcgtgaacccgggaggcggggtttgcagtgagccgagatggcgccactgcactccagcctgggcgacagagcaagactcaagtctcaaaaaaaaaaaaaaaaaagaacagagagcagagccgtttcaggccctggtctctggcagacccctactcaccttcctgggcatgtatccaaggtccttctcccatggcacctgcttcctctgccatcgtggacttaatggccaagtccaactcctcctttcattctgcacacagccacaagagccatccaaccagaacacacatctgatcacaccccctctggctgcgtggctcccatggtccttaggttcgggaacaaatgcagccttaagatggccagccttccagcccggcatagaccccaggaaatctgtgtgctctccaacaggagtctcctcctctccctgagggtcactcatcttccaggactccccacccctccctgtgtcccagcaggtgccgtgtggccctagctcagagcagccttcttcatgccctgcagagccagcctgtttacgcagcgtctgcttgtgctcacggcatgtaacatgcatagtgcagcctgcgggagaacagttcccttctctttctgtctcaagagctgccggctcagaccttccctactcggcctgtgtctccccaaaagagcgcagtgagctgcacggagccggttgagcctggagccaccagatagatgtctgccccgccctgcccagccacaggggttggtgggtcatggaaccacacatgaccctccgagggcaggtgaggagaaaggagggctgatgggggctgatagaaggggtttgggggatggggagcaccagagaaggaaggctggcaggccgagggctggggagcaggggataggccttcacatttgcatttgcaccgttcactgcgggctaggccacactcacacacacacttacacctgcacccacaccctctcaaccacacgcgcagctcccactctggctcctgagccatctgcaggccaggagactccagggccgggcttccccagcaggtctgcccaccaagcccaactctctgggaagtgccactcactctgaccctgtggcccggctccggctcaggggagctcccactgcaaacacaagctctgggaaggtgagtggaggctttgtctcaggttctgaggcgtcaggaggaacaaatccatgaagtggaatgctggaggcatagaggtccagcccatgggccacctgcaccccagggggccagtcccgcatttacacaagtgacttgtacactctcctcctgcacatctctggaggcttatcccatctggccctccatggcctcagcaggatcactggatgtccgtgatgcacggcgtgccctccctgccctcatcctcccagccagcagcccaggaaggaaccactcttagtgacctgtggaaggttaggagaccctccctcggggccctagagcccaccctgaacagggcctttcaggggagagggtgagaaggttcaccacccagaggagccaggccaaagccctgaaaccaaacatcccccagttccctcactcctcgattcagactccagggccacagcctggagcagagctggaccccagctcctcttggcagcacccctgagggccagagaacggcttcccagctgacttgaggacctgtgacctcagggggatgcagggaaacacagagtgtcacttccagctgcacctgccctctgccactacccagcagtccgggacctgagtcccctccttcctcgcggagaacagcaggtccagcatggccggcccttccctcgctggctgtgcacagggtgccggctgagtcctcgccccatagttggcaagtctagaaccaccggatcctgttacctcaccagtgtgagttctaccattgccaaaaacggggggaggcaagcagctccccccaggagctggggaggcctcggtctgtgctgaggaagagacagagacagttaggatggtccaggcagggccaggacagaggcgcccatccccgcaactgcgacaaggtccttcctgcagggtcgccctggtgtggaggcccaaccccacagtcccccttcctgctggtcccggtccctcctcagccccctcctctcctcccttcccctcatatctgtaacctgcagttcctgtgggcaggcatggagcagacaccatccctagggcagccaccaggatccaacccaggccctgagctgtggtcaccactcccaagggaacccgagggcacctccactcccagcacctgacagcagggactctgggaaccagcacaagccaggccagagagccctgcccctgggcgctggggaagagatggctaatgtgggctgggttttgctatttactaagcccacgtcactgctccatttaatccagagagatgctcccaagccattccctagagcctaaagctcacaggctgcccaccccaaagggagagagggaagttgctacacaaaacattcctcctccctatcaagtccaagggaggaagagcattccacttgccaaggcctcttccctaaaagcagtggacaaacaatggcgctgggaccttctacccaggaacgggaacaggcagcctctggggccatcagtcagtggcaggaatgggccaagctaaaaccaaccaaatatctcccatccagacggcactctcctgaccacagaacccactgcacacacccagcagccctgcacacacccagaccctttgagggctggctgcgatctgattctcggagtggcatttccccagaccgccagtcacttacccaagggcagcacacttccgtgttcccacttcccctgatgaggccaggtcctttcccaaggggtgttgaagtgtcctgaaggcatctcaagcctttagcaagggtgcaggctgcctgcccccaaccctgcatccccatgcctcccctgcagcctggaagggactctttgccctcaagcctcctgggcagtatgggcccaccatgagcaggctcattttccgaacatgccccggctgggggagcagctgacttggcagggcccccaaaatgacaccgctgccgccgccaccgccaccacccctcccatcctgcctgccctttagggtggagtgagatgggatgatggcttaagatgcaaacagatccaggccatccccagggccaagtccaggacctcggtggcacccagaccggaccggcagcctgggcttgggcgctggggaggacacctctgcccgaaaggagaggcttggtggggaaggtttggcctctgagcagaggcacgactctggaagcctctccgagggtgggcgggcctgctttgggacatcagcagcactgggctctcttggtcccatggagcccccaagcctgggacttgctgaggaggccactcccaccctcctccagtgtgtatgtggggggtcctgtcctcctccccacccagctgtggccgcaccagccgggctccatcggcagcctggggctgcaggcgatcaatggtgccggatcgcatttcgacccgcctgaggctgggcagaggctgggataatggcctggaatgaataagcaaatggagtggtgggggaggcggggagtctggaaaacccactcatacagccctccagggagctgcccctcctgccgctccacgcacccagacaggccaagcaaggtgcccgacatgggggacgccctaaacccgggcatctgggagccgctgcttttgacaaacagaaaaacaaagcaaaaagtgcttctcagtgaccctcccgctccagcaagaaaggccttcgctgcagtgggacagcgttcctgcctgacactggacaccattggacagatcatgggcagaaccttttgcccatctcacagaccttctggaagccacacaagggaggatccaggacctgttctgcagggtggggaggtgaagaggggccctctcctatcctaagtgcccccagcctgggtggtaggaaattgtgtctttagggaggagggccagctgtggtggcccccactctctgggacagtcactgttgtgggtgaactcaccacccaggtctggcccggaactaggtaaattaggagatctagaaactagctttggcctgaggtcctcccctggagcgctggagcagggccccagagcagccgggcctgaagcctggtggaggcacgcccccacaccagtgcctgcactcggggctcagcaaaggcgcccacctgggcaggtgtgaggaggtggagcccagctgcagaccacccaggggctgagggcagcttctgtcatccggccttccccgctaggcaggaaggagcagaaccctggccagacactccagaggctccagggaaaagctctagaaccggtcactgccaggggccttccacccccccttgctgggtctctgtgcccaccccacctccagggctcattctcactcaggccgggaaatcccttctttcctatcccatgggacctgcagcaggacgccctaaggaagcacccggggcggaggactggagcacagagacagggtgcggcacaggccagccaggttccgaggggcagagggagagctggggccatcagaagagagacctagctacagggacacctcaccagggcagaagtccccttctatcctgaaataaacaagcccctccttttttctgcaggggcttggagagcttctgtagagaaacacgggcaccacaccccagagggaatttattgggggctcctcgcggtttggtgatagctaactgacaagaaaaaaaaggcccaacccacccaaggcagtccccagggcacccaggcaggcagcactggtcaccatgttcctgctgtgcagtcaactggacccgtcatcctccagctgccagcttcaaccacacacatcccccacccgggcactccctggctcagacacctaaaatgactcccactgatctgggctaagtccaccaacccttgcctgaggctccctggggagaagcagccccatcaggggctggcccagtgacctggggcatgatagctcccagctggtcccaagtcggccactggtctcctgcttgattgctgaccaccagatttcacatgggtccagcctggctggccaggctctccccagctttgacagactaggtccaggcctcccagcctcagtctctgccatctggggcatccttgggagcccaggcctgtagattcagagctgagacacctccaggccctgggtgcctccatggaaggtgtggctggtggcggaagagccacagtgacccagctctaccactcaccaacctcttcagccaagcctttcctctcaaagcctcaggttccccatctatgagataactattttaaaaaattacaagccccacagggctgaggtgggaactgttgggattatatatgtaatgtcacctgacacccagatggagagcataggccagttagtcatagcccagatccagggacccaggaagctacattaccagtgtgtggtgtgtgaaggggaacattggcctctgctccagaaccttctaggggcaggcctgaaaatgccctccaactccgagccccactaagtatcctcctcttggagctgttcggagatgacccactccacagcaggctacagctccagagacggtagcccccctggaaacacccaggctgacctcaagggcagcccacctgcctggagctgcccccttcacaacctgcagcagaaaagaccaggccctgtgctgccagccaaggtctcaccccaagcgtgtgctgggagcctggctgggcctttccaacccacggcaccattcaggatggccctacagatggtttcagactcccccacctctgccctgggcggccccatctgctggcccagctcagattgctgggctcccagctctaccgtggccccaggcagtgtaaggcgatctggctgcccaccagcgctgggccctcacacagcagctgagccagatgggctggggaggcggtgaggaggccttgaggaggagcaggctggggccctgacacaaggatgcaggggaggcggacgcagctgcgggtcctgcttttcccatattggcactgcacatgattgctcagagcggagagacacaagcaaaaatgtgctagtgccaaaatcggccaagcagatggcactggtgcgggctctctggggacacactggacgaggggccttgcatccctgcacccttggaagcagcctgtttccgacgtctaggagcactcaaggcagaagtgggtaaggtgctccggaggccctcgtggatctgtctctgctctgtttatggcccttcggtaattcactgactgagactgttcacagtgaattctaccagtgccatacacagaacaggagtcacactctgcggcctgccgaccctgcggagagaccagcggcccacgatgcccgttccctgctcctagcctgcccactcccttgggggccccccagcaggccctcagcagcggctgctacggtctctaccccccaccccatcccacctcttcacaagatccacatgccccatcagcccaagatgaccttcaaggagacagggacagtgcgggagaggagctgaccttctggccttgcagaggagaagaccacaccaaggtgtctcctatctccacctgaaggcccacatccctccacatcacccagactgcgcctccaggctggggagggagtgggtcaggaccatccatctccttgccagagtaactctggctcggagaggcaagcagctggccagagcctcctctctacccaacctgccacaggggcagtgaccagtgggacatccaagatgcctctcgtagcctctgagcccagacaccagcagcccaggctcctaggcactttggtctccattatcctccaccccccagcctgccctgtggcagaaacagagccccaggaacaaaccgaatctgctgctcacccccactcccatcccaaaccagaccagattgggccagactgtgaaccgcccaggctgggcatctctgctgccggcctaggatcaaggcaggaaaaggccaggaaaggagggcagaagagaagtcctgcagccacccaggtggcttggagggagccggaggcacggatgcactctagcaagggagtggctcctggctggctctggagtgactgcggaggaaagcggaggctcaggagcgagggaggggctgggaaggttgcatcagtggttgccagagcagctgcctagagagaagttgctgtggaggccctgcctctggtgtcacaggccctggggaaggacgggaagaagggagagggtgggagggagggtctctggggagctggcacccagggcaggcaagctggggcctccgcagagtggccactagagtctcagcctactccaggtcagcggtggcccagaaggcagggtggctagaaaatatcctggaagggtcagagcaggtgccctggcccagaaactatgcagacctcttggcgatgttacccccaggaactacctcccgtggacctcagagctccatctgggtaccttggccaaagccatccgctctcccctagacactgcttaatgctccacccttcctgctcccgaggactctttgtcctgctcccacacacccccactacagggctctgcccttctagctggtctatctccccagaggacaatccagcttgatgaggtggtgatctcaggaagtcactcctcagccttctgcctcagtttcccttactacaattttctgaactctactaaggaagagagaccagacttcccagccttgggtggggaggggaaggggtgatggcagggtgttagcaaagagtatggggtgggtagttatgaacattgcttagggtgtagccataagcatcacccaaggagcctgttgaaatgtagattcttgagcctgcctggaaatctgcattttaatagcaccctgacagctcagcatggggtgggggtgggggtgggaagatctattttgagaaatctttcccaagaagcctcaccctgggataattaaacagaatgcagaattcttctttcttctggctgggcgcagtggctcacacctgtaatcccagcgcactttgggagacgggaggatcgcctgaggttagaagctcgagaccagcctggttagcatggtgaaacccccgtctctactaaaaatacaaaaattagccaggcgtggtagcaggcgcccgaagctgaggcaggagaatcgcttgaacccgggaggtggaggttgcagtgagcagagatcgcaccactgcactccagcctgggcaacaacagagcgagattctgtctcaacaacaacaaaaaaaaaaaaaaaaaaaaaaagaattcttcattcttcttttggggacagccaaggatggggagaggcaggtgttagggaaggggaacacgcagcaccttgcaaccaaggagccacagaggccttagagctggagaacagatggagccagggattctgctctccccagcccaggaaggaataaaagggaccccaggtagaggagagagccctgtaacaaagcagccaaacacgtacgctccttcaaattgtggcatctctgtcgagctccttggtctgttttcctcatctttgtaactgacataggatggaatacagggagcagctcgcaaagccaaatccctctccacttccagttctagtcggctgggccaggttcctcccctgcgcctgcctcacccctcctaacccaaatgcgacaggaagcccaagtgccgcagtgcctggggggtgccacgcccgctggggcctctccatcctggtggagggaggctggggcctgggccctagggaagcaaggtctcccagctctctcgaaaagcgggtaagaggagctctccgacatcagcagcagaatccccactcggaatctcaaaagggaaaacagaggcctatggcttggcgcaggtcaggatagcagcctcttctgccctccctgcaggacacagccctgaccttgagatcaaaggcacagaaatccgcttctggagtgggaagatgaagacaaggtctcccacacccgctgggcgtcagcgcctggcaatggaagaggaccaaaagagatgcaacttgcaggccaggctgggcagccagggactcacagggtgtgtgggggtcctacacatcctaggaggtctccacaaagcgccccctcccaccttcggtcgctctcagccccaccctcctgaactctacttgggccttcttaaaactcgagtcccctttcccctaggggtgtcccttcctgggcactggtgcccaatgcaaagggcaggcccccaaccccttccagtgttagaggtgagtgttgcaggactctgggctatgggtactccggggtccttagacagcacatagcctaccgctcgactcctggctctcctctccacctctacacaacgaatctggagtccagggtcccagccgcgccacccacaaccggtctggtcctgatccctccagtctctatcaaatgcccctgaggtcccaggggctagaggctgctggggcccttgaacgggcatgccctggacgctgcgcctgtcatcctgtgtccccatgaggtgctgggagaggggcccagagctcctttccccgaagcccaggccgccaccgacccattaaataaatactcaggtgtctggggtgcggagctcactccaagagccactgggccccggtaggagaaaaagaataaacgaaatcctcacaagtgaggccggcatcctagaattttctcttctttgcgtaaggccgactccagaggtcccgctaactcccccgcaggagcatgaaggggcggccttgagcggtaaagaaacgagcagtggtggaggctgccgctccgagcccaggtccgaaccgagagccgcgcggggaatgtgggggtcgaggctgagagctgggcttggggcaggttcctttgcgttcgctcaggccacgatgaggccactaggacagatttctccgaaggctcggcctcggatcagagatccgccgactcggtgcccatcggtcgggctcactgggtgacaggtagagggtgatgcgcacccgtagagctgagtgacccggcccgagaatccgccacctggctcgcaggattttcgccctcaggagctttgcgaagacgggcgcaaacctgggaggcgccgccgcaccttgcctgtgggggtggggaggtcgattacggcaccgcccgccctcggccctaatcgctcagagccggcctcagtgcccctgcccccggcgggtattactgtacacggtgtccgggagcccgggttggaagagcaaacgaatggctcagcctggaggacaccgtggaatcgggcgacccctgaccccgggtgacaccctcactgcccatagtcctgggatgcgctgaccggtgaggcgccagaggcaagccgtccagccgccgatcttggggaagggctgggaacctgggtgccactagcgctattaacaggaatggggcagttgagggcggggaacggtgtctcattcgcgtgcgccggggttcccgggatgagtggccgcgaagtggaggcacacgggaggtctgagagccgctttcccccagagactgggcggggcggctccgggccacggaagcagcctcgaaccagccgcgcagccctgacaagacgctggaggggccagctccggggccccggcgctctccgcagccccctcccagcctggcgcttccgcctgagcccaccagggcggcgaaacgcagcccgaccccagccaaactcctcgcgggtaggcacctcgcaagcaccggccgcactcggaccgcagccgctcccgcccccgcccccgcccgggaacagcgctgggcgctgggcagacgccactggcggacccgggacccaggcgccccgtgggcgcctccgcctgaaggcgcggaagagcgagtaggcactgccgcgtcatccccgaaagccagctgcgccgggacttctgccctgcacccgggttctagtgcggccggtcccgggcgcccgcctccgcctcctctactgagccccgctctggctccgcccggcccgcccccccgctcccggccccagacactcacctgcgccggctccaggctgggcgcacagccgcctctcagctccgcgcggagtccacaccagagaagccaggcaaaaacggccccggtttggaaagagccgcatggacggagcttgaagcgcgcccggcccgggcccaaacctccgctgccccgcgagagggggcggcgccggagcgccgagcccagcgggggaacaaaggggagccgggacccggccgcgcgcttcctgggtgtcgggtgacaggtctgccggggaaggccccggcccggccacctgaagaggagccgcctccgcgctgcaggcgggggaggtccagaggggtacctgggcccgaggaccggaagaacagggggcgcgggctgcccggaccgcgcggctggacggaggccctgcggctccggcacggctgcgcgggggctcgacggagtgcacagagaatgactccaggagggttttaccgccccccgccccgggccccgcccgcccctcgcgcagcgccattggctcaggtgccgcgaggcggggaggggcagggggcgggccggggatgattcaccttgaatgtggctccggttggtgcgcggcgcagggcacgcccgtccgggactgcggagacgccgggagccccgcctgcttgcccaacccggccgggtctggccccaaggggtcccgtcgcccgccttctatccccgcctcctgccctcgggctagggtgccgctagccgaggtgcgcccggacgccctgccaccccagcgccctctgagcccggagctagccgaggtgtgtgtggcgtggcgtgcttggaaatccgaccctgggaggggggaggggaagtgcgttgggagctggggcgcaccgtagggccactggacgatctctgcagtctccccgcagaaaggtgctcaaggctgacctgtctcagggggcgcacccggacccaggggcgcagggctggaatggggacaaggggcctccatgtcctcacacgcccaccctcggccagttctgcggcctcacaggtgtctggccaccgctgccgccgccgccgggaacaaaggctgtctgtcccaagagagggagggggaggggagccgccccccagacccgttcccatctccccctccccccactgcgacagtggctccctcgggagggggcggggccagccggggctggggcgcggacgcggattagatccttctcaaccgtcctttggtctgacaccacccggagcattcagaagggaccggggggcaggggctaggtcctccaagctgtcagcgttggggtggcctcttccttcttccccagcatcctgagcaccggagcgccccctccctccctgctgctttggctgcccttggcagtcccagctccgccccgcccggccgccccagacggcaacggcagctcaaaaccagattaaaataaaacgttaatccgcccttctcctttttagcttctagttcttcccaatcgacccccgcagatctggcaccctagaagcccctgtaaaatgagggtggtgcttagcctatgctcccaccaaacctaacccttgcacttgaagaccgttaacaccttgtcttgggctcgagcaaaagaagggggtgaggcagtggaagcggggcccgggaaatctatagtttccccacccccagctcctgccgagccgggaggggccaagggtgacggcaaggatacgaacccttcaatatgcccgactcccgggcagggcctgctgaagccgtagatgtcgcagccagatggatcgggaagcaagattcccaccccaggtggataactggacgagtctcagggcctcggggcccctctccccatgcagccagggatgggcacggtgagcgagaacccggacagcggagataatgagcacgtcacagagcccaacgggccaaaagggggtgatagctccacattaacccctccccgtcctactagcattcccccgcccatctaggtcgcctcgagcctccctggctgtctctgcacccgcgccctacctggtcctcagacccatgcgatgctgggcaacccgggccgggtgtgcccaggaccgcaaagcgggaagcgcaggccttgcggactgcgagtggcccccgcggcctgctgctcccctttataacgcgcgccccgccccccgcgctccgggcgccccgccctggcccattcacctgctgtcgagaaccagacaccgcgcagcagaaagctagccgctgggccgcgaggtccggccgtcggagcgggcggggctggggcgccgccgagacagatccgatttccaccttttcttaaatgcgctgctgaaagtcgagaaggccccggccggggagctcgcgtcgcttcctcccccctcagctcccctcgcaccctgagtcccccagccccactccgggaggggccgcgaaactgcacccgcaagggcctcatacatattttaaggagcaggccaggcaggtaaccggagctggactcggacggtgagggggcggcccccggggacctgataccctggatcccttacggctcagggctcaggcgggggaagaggtggctcaggacgacctggggtcctcactttgctggcctgtccagcgcatcctaagcccgcgtgtatcctaccccctccttctgcagatccaatgtccgtctggcaattgccccattccctctcgctggagagatcccttccgcctcgccacaggcgtcccacgctgcccggagtcgtgcgccccgggacgggtagttttgggttcctcgacgcttggccaggtttaggaaagacccgctgtcttccttgctgcccccacctaggagactcggcgccttgcgctccgtcctttttaatggtgtcgcggcttgtccctctggcttgctccctcctagtccctaccccacacggctcccttcgccagctccatgacaatcccactcgtgctgaagaccttgggcaaagaagtaaccatcggtcttcccctcccttcccattcctccggcggcaggactagggggaaaggtgcccgggatacaagcccctcacgcagacccactgatgcggccgtggttctgccattggcccctctccgaatggtgaggttctcctgctaaccctggccccatggcataactagtataaccccagtgagaggaacccagagttccagtcctcccctgctccagtccctctgtgatctcgatctcgagggattcacttcacctctctaagcctcagtttcccatttgcaaaatgggcagaatgactcgcacctctggggatgaagaaaatgcacatgtgagcacgtgggtacttggcgacccggagatctctgcaaactgcaggcccagcgagatggcctcagcacgccctgcaccctcgtccgcgcgactgccgccgggtgcccgccccagccgctgtgtccctggtgcttcctccgccagggccacgtgccggggaagccaaagcgggagtctttcgatcttggcccagcccttagccctcggtcctttgctctagcatctagattctcgtgggtcaacaaagtcactggaaacccaacgaacttcccgacatttttcgaaaaccgtatgcgtgtgcttctgtgcgtttttcctctgatcgaggtagggccctgtagggttctgtttggacgggaggctggagtggttccttcccggctgcggggtcggaggatgcagagattcgaaagaaggagaaacacagagactgtcaaatgaaaggagattctgtcttcggaatcgacccagctctttaaaagaatgaggaaaacatggggtctttatatatcctggaaagtcgcctaggcgttcagtgaaaaacgcaaaaggcacgtggattcctatttgtgtaaaaatataaatggggcagggggttaaacatcaggttttttctgcacgaaaggtctcagcgcagagggttggagatttttcttttcattgtatgtctttcgggactgttcgaagccaatgtgtgttgcttaccatattcttgcattgaattttcaattaaaaaaagaaactgcaggaattgttttttgtttgtttgtttgttttgagacggagtctcgctctgtagcccagactggagtgcagtggcgctatttaggctcactgcaacctccgcctcctgggctcaagcgattctcctgcctcagtctcccgagtagctgggattacaggcgcgtgccaccacgcccggctaattttttttccttttttctttttttttttttttttagtagaggcggggtttcaccgtgttagtcaggatggtctcgatctcctgacctcgtgatccgcccacctcggtctcccaaagtgttgggatcacaggcgtgagccaccgcgcccggccaataaattgattttttaaaaagcaacctgggccgggcgcagtggctcacgcctgcaatcccagctctttgggaggccgaggcgggtggatcacctgagatcagaagttcgagaccaaccagcgtgactaacatggagaaagcccatctctactaaaaatacaaaattagccgggtgtggcggcactcgcctgtaatgccagctactccggaggctgaggcaggagaatcgcttgaacccggaaagaggaggttgcggtgagccgagatcgcgccattgcactccagcctgggcaacaagaacgaaactccgtctcaataaataaaatgaaataaaataaaataaaataagcattcgggatgctgaagcctgcaggagttgaatcagagggcgagctgcagagcggaggcactggggcggcgggccttgcccgggctcttggctcccatgaatcctcgatgagtagagaatcgtcgctcggagcaaaggcgagaggagagagaagcgtgcgggtgcggcccttgctgctttttaccaggcgacaccccggtcgactttgacccccgagcaggtgaaacataagcgtccaccccagaggggtcccctacccaagtcagaggagaaggtggcctgccaggttaaaggatcgagtccagcctcggtttcctcatctgtaaaataagccgagaacatccgcgcctctttctggagaaggctgggaggatgccagagagaaactgcgcgcaggccctggcgaggagcccctccggcccatgcggaactctgcacaggctgggtccctccagggttagaaacccagcttccccacccctacccagcagggacccgcgctgcatcccctaacgccccccaaccctctgcacccagacccaagagccggccttcgacgcaccacatgcgtggagcccgggtcccagccctgaggaccaggtttcagggctcagaagactccagcgaggttccctcgcagattgtgtctgcggtcgttgggggaggggccccgcagccttcagcagattatccaaaggtcagtgacccagatatggttttggccacgggccatgtttcacttcctgtgccccaagcagaatttagctgaataattcggaccccaaaccaaacaaaacgctcttatttccgtttggggattcttcggagttgggatttttctgtctcaaattagaataatctgcattattaaccacttaacagttatttgttggttggctgcctgacctttctgagcctcagtttcttcgtctgtaaattgggagcttacccaggtcggaggactgttggaattggaaatattcgaataaggaagtgtttttgcaagtgctttgtaagcagcaaagcgcttcttcaggggtcaatttttttttagctctgcagtcaccacccaaattcggaagatcgttgtgcctttcttggatgagaatgcccggctccagcccggggatgggacggtcttttccttgctaggagtccgctgtggagggggcgatgcgctctgtccaggacctaggagtccctttctccctccaccctcggctcacagcgggcagctcccccgacgcgtaccgcctctttgcccccagcctgaggtgcgctcttccccaggacgcctcctctgtcctctgcacgccgccggccctgctggggttgctttctgccgcggcgtcttcgcgaatatcccctcttgctgtctgcctgggcgtccctccgggttaccgcacaccgcctccgaccctcccagggcgcgggaggaggggcagggcatccgcgttcgtgtctgggccctggcggggagtcgcgtggtccaacccctcgtttttaagaggagggatctgaagcccagctaggcttctaattccagacagagccctacggagcccagttctctggaggctttcctggggcttttttcactaggccaggttgggtgggtctggagagaactcccgcaaccggaaattaaagaaatgcagagagaaacctggggagtggggccaccctggtcccctgggcaggctccggtctctggaccagtggggcagcagaggcctcgggagctgcagagattttcctgggcacactcctgaggggtaggtgcgaagctcctgctgggatgcctagaaagagggttatcatggggtccctggctgccggctcacagccgctcctgcttggagaaaaggcagggcagagggtaggggatgcacgggtgtggaaggaggggatggaggagaaagaccacaggcggtttgggttgttgggaggggagggggtgtgtgggttgcgggggtgggggggaggtgatcaagaatgatcaagaatccccgaagctctttgttcgttctttgatctgctctttttttttttttttttttctttgctgtttgtttgttttttgagacggagtttccctctcgttgcgcagggtggagggcagtggcacaatctcggctcaccacaacctccgcctcccgggttcaagagattctcctgcctcagcctcctcagtagctgggattacaggcgtgcgccaccatgcccagttaattttgtatttttagtagagaccggatttctcaatgttgatcaggctggtctcgaacttcccttccgacctgaagtggtccgcccgcctcggcctctcaaagtgctgggattacaggcatgagccacggtgcccagccctttgatctgctctttaggaacctccaccaataaccagaatcctttgatctgctctttaggaacctccaccaataaccagaatcctttgatctgctctttaggaacctcccccaataaccagaatccagcagtctctccgcagtacctgctgtgggaacctgctgggcccccggtagaagggagggtctggccaaggcagtggggatggagttcccacagcaacagcaggccctgccctaagggaagcagcctgtggcctgtgtcgaggacttggagctgctgtgagctccctgcagatgctgggttggaacctggcctcagcctccagatgggctagcttgggggaattcctgcccagcatttagcataagtccctcctaatggaaaatgcaagccccactagggcaagggccacatctgccttgtagactgcggtatctcctgcctgactttctcggaaggtgctccatgaatatgtgtttgaattaatgagcaagggctgtgcagggtgcagtcacaaccaggggccagcgggattctcccgcaggacagtgagcggagaaactaaggctcaggcaggctaggcagcacatgctggcctggacttctttctgtccatcacagctgcctgctctgtgctaccccttttagctagcaatggccatgcctgggcttcctcttgggaggtcatttcaagggaggcagaaactcctcagtatggctttaggggtattctcctcttccctttttcctgtctcatggatatggtctttgagtgagccaattccacctctaggcttcagtttcctcatttgtaaagtgagggctggaaggaaaagcctttcctgtcttccttcatccctttatttttcttttccaagacacgttgaggcagaaacagaggcagacaagctgggctgcacttggaccaacggagcccactatgctagatatgcatgggacaacagacgtcccacgccgcttctggatgtcacatgctcttctaactggttaaactagcacatgcggtggggcttggtggctcatgcctgtaatcccagcactttggaaggccgaggcgggcggatcacgaggtcaggagatcgagaccatcctggctaacacggtgaaacccccgtctctactaaaaatacaaaaaattagcctggcgtggtggcgggtgcctgtagtcccagctactccggaggctgaggcaggagaatggtgtgaacctggtaggcggagcttgcagtgagccgagatggcgccactgcactccagcctgggcgacagagcgagactccgtctcaaaacaaaacaaaacaaaacaaaactagcacatgctaccccaagaacttaatcatcaagtcccacaggtctgggtttttgtttttgtttggttttttttttagacagagtcttctctgtgtcacccaagctggagtacagtggcacaatctcggctcactacaacctccattcaagtgattcttgtgcctcagcctccaaagtagccgggattacaggcacatgccaccccaccccagctagtttttatatttttagtaaagacagggttttgccatgttggccaggctagccttgaactcctggcctcaagtgagctgcccacctcagcctcccaaagtgctgggattacaggcctgagccactgcgcctggtctggatcttaaagcagagaccatgtgggccttcgaggagctcacattctccttgagatgaaaaggaagcatgctggataatgctcccagcctctgctgcagagaaaccaaagctggcctgctcccctgccagcagagactaagtggggtggtctgagattgaggagccaacagactcagcaaacacatgctgacaatcctcctcatttggtcttattcaccagcagagcccccatgggtataagtccagccatcaggtgacaggaggagcggctgagccagggctggattcggggaacgctcctcttcctcttcctcccacctccccaagctagggtgtcaggaatgtatcctaaccttgggcctagccttgggctcccttccatccttggttttggagttagggagctgctcccctccaaccctacttcaatgggtccccaacacaaacccaggcctcagccctaggccacctgccagctgatggggtctctttaaggaattgatttccacaagtccctgaagtgtttcttcggcagtaaatctcctgccacccaggctttctggcccatgaatgatttagcgccttggaggggttggaaccgtcttcctgtgcagtggaggcctgcagtggtgacatcacagctgcaatggtgatggatggactcttctaccctaatggggaggagaatgcacaggccgctgggaggggtcaggccatgaaagtaagtacccatctggctccgcagatttctggtttggggttcttactgatggaccagctagctaattgccctcggaggtacctagagaaagggcccgagtccatctctctgtccccagcccagagggacacaggctcatgtcactttgaggtttgcctttccaattcctaaagtgctctgaattataccgagcgccgtcttcccttgctccagtgacagcacgcatacactccaacacacacatgcacctgcatgggtgtgcacacacatgcacctgcatgggtgtgcacacacacatccactgttctcaacaactctctcaggaagttcatcattatgtcccacctaaacgtttcttgctactggggaagcccatttttctctgattccatctggaattgacagagaacagctggtcattattagccatatgctccccctccaagcacacatggtgaatagcagcatgttcttggtcccttctccactcagagccccctcccccatcatctctcctctaagcatcaatgaccctagttatctctgttccaccagcctttgggggaaatgacaaggctttagtcagtcagcatccacagggtgccaacttcttcaagggagggtaggaagtggagggggtggtctctgaggcagggagtagcctctgcccactcttgccatccctgacaccagctggccctggcctatcttggagtaagtataacttggaggaggaggtaaatttcctgcttcaaaatagcttccccccattgcctatcctatagagacagccattggcttgatttttctctaagattgaaactggggtatgcaccatgcaaattcactgctatggtgcacatcccggattggtactggggtgtgcaacatgtgaattcactggtatcacatacatgttagcatgtcttagtttgggcattccagtgcgtgtgtaataatatctcatcatggttttaatttacatttccttgatgacaaatgatgtgagcatcttttcatgggcttacgtgcctgtgtgactgagtgtgagggagacagaagaaaggcctggctctggagcgttaggggaatgttgcagagtgagacgccacaatgaagggctccaggcacttcggagctcactgtggaaactgggcacaggtgagccaagagagagccaaggaagcaagcagcttcaactgaggccagatggatcatggtgcacaaaattcttccctgaaccctttttttttttttttgagacatttgttgcccaggctgaagtgcaggggtgtgatctcagctcactgcaacctccgcctcctgagttcaagcgattctcctacctgagcctcccgagtagctgggattacaggagcccgccaccacctgggctaatttttgtattttggtagagacagagttttaccatgttggccaggctgggcttgagctcctgagctcaagtgatctgcacacctcagcctcccaaagtgctaggattgcaggtgtgagctactgtgccaggacccaaacactttttcattttcccctcagatctctgaagggtgggaagatctgaggcttcctgtgagtgtgcattttccaagttcactcagagggcacttggcagatgaaggctcagacccaagcgttctcgctcccggcctccatagtaccactttgctgtttacaaagtgctttcatggacatcatctcatctgattctcaggataaccccattttacgagtgagaaaactgagacttggagagattgagtggcttgctcaagccatccagctagtgagctgcagagcagaggagactcctcgggctcctccgtttgtccctagagaggctcatctgacctccacctctcttgttgggattgatggagtccgctctgccctgcttaactctgctgggggcaactgcaggaacttactcagaccacctgtcctaggtgctgagccagtcccgacttagtttcagctgagccacatttagagaactgttaacatggtggtgttgaccttacctgtaagacccctggccacctcactcaggttgctctcagtcatgagattagaaaaccaagatattcctcccaaagactcttctcacatttgttgtatcttctgttttaatcatgaaaatccagatatggccgggtgtggtggctcacgcctgtaatcccagcactttgggaggccgaggcgggcgaatcacgaggtcaagagatcgagacgatcctggccaacgtggtgaaatgtcatctttaataaaaacacaaaaattagctgggcgcggtggtgcatgcctgtagtcccagctatccaggaggctgaggcaggagaatggcttgaacctgggagacggaggttgcagtgagccgagatcacgccactgtactacagcctggcaacagagcgagactctgtctaaaaaaaaaaaaaaatccaggtacaaaatgccttattaccacacagggtgagatctcgccctgactttattcactacctgcaagctcagacccccatctccgatggtcccaaagcccataagttgacagtacctgtctgacacatagtaggcattcattaaatgttcgttgaatgaatttgaatggggttcgttgaatgggatttgttaatgaacacggcttccttttcctgaactgtgattaattttaaaacccaagaggagggaagtgacatttattgggtaggtctttccattcctcacctctgccgtgtgaggttagcattattatgccattttatggatgagaaaatggaagctaaggctgggtgcggtggctcacgcctgtaatcccagcattttgggaggccgaggcaggcaaattacctgagctcaggagttcaagaccagcctgaccaacatagcaaaaccctgtctctactaaaatacaaaaaaattagccagatgtggtggcacacgcctgtagtcccagctacttgggaggctgaggcaggagaatcgcttgaatccaggaggtggaggttgcagtgagccgagatcacatcactgcactccagcctgggtgacagagcgagactccatctcaaaaaataaaaaaaagaaagaaaatggaagcttgaggggttcaataatttggttactcagctaggatggggtagagccagcatttgaactgggtctgagtgccacactgaccctctgtccattgtacatgaggagagaaatcctgggtgtccctggataagcccagaggcttccagtgggcagggagccagcctgagatcctgggctctagagatgccttggcctcattgggctgactgtgtcagtcacagatcctggtcaaaagctatgaatttcaaactttactctagagctgtattccaatacagcatcagctgaacaacagagaaagctgctctgctccaaagtagcagtctctagtccaggggactttccaaccattttgaaatcagcagtccagcccctgccatcccagcctgtgcctgtctcaggccacacacagcagccatttgcagcttgtggttgctactggccaagttcaccagaggcccggataccagcatgatggttcccagccccccgccggggaggaggagagggggtcattgtggagatgataatgctgctccatgaatgtccaacttcctgaaaaccaccgggacacatttcgtttatgtgcttgtttatctcaggcctgcttccagaagggctccgaggagcagacaatgaaagaccaccgacagaattgctgttcacgggccaggcgcagtggctcatgcctgtaatcccagcactttgggaggccgggcgggtagatcacctgaggtcagaagtttgagaccagcctggccaacatggtgaaaccctgtctctactaaaaatacaaaaaaaagaatcacttgaacccggaaggtggaggttgcagcgagtcgacatcgcaccactgcattccagcctgggtgacagagtgagactctgtctcaaaaacaaacaaacaaacaaacaacaaatacaaaaaacattagccaggcgtggcggcaggcgcctgtaatcccagctacttgggaggctgaggcaggagaatcgcttgaacctgggaggcgaaggttgcagtgggccaagattgtgctgttgcacactccaggctgggtgacagagcgagactccatctcaaaaaaaaaataatgaagaaactgtgtcaaaaaaaaaaaaagagctgttcatggaaaaagaataacaaaagccccacagaaggaggggacagagttacacggaacctccagccagtggtgatgtggcaagggacagtcttcaggtggcctttgtagcagcgtggctgcttcccctgggttgactcacttttcctccacctgatagtccaggggacatgaggggaccaggtcttggccagatgccagatctgagcatttttcactcaggattctctcgcattgagagacacaggctctggcaacggtgcccagtgtgagtggaatttgggaacactgtggccaggtggttggcacccaagcgtttccctgtgtcctgcaggcaccctgccctctggcctgcagcccttttgccagggccaccatggcccttcccacagagaccagcacccaaagtgggcaggagcagggcaagatcagggcccagcctggaagcccttgcccaactgggaaccctcagtaggaacacatagctgcagcaatacgtctggggctccaggaggagcttatcgcctttctgtctctctccctcacagcccattcagcaggggcttgagcaggggacagggaggctggtgaaaggccacccgaggctgcttttcaatgaaactatctgtgtgcaggatagaattacttgtatcaagtacaccaagacttttaatccattttgtaatcaaacagggcatctctctgggcccctatgagcctgagatgacagcgtagttccacccacttcacaggtggggaaactgaggtgatggagagggtcagaagtaatccctttcagcccagcaggcactggggaattctgagctctgggctcccaggccaccccagactggctgaagaatgagcaacacgttgccctgggttcctccttctgtccccagccaagatgggttctgcttctggttggagctcttccaccatctctctgtacaactttgggctagacgtgtgtgccttggtttccagctgtgcaccagggcagtgctggccggtccgtctgttgtctggagtggctatgcacctcaaatgggacagaggaggggagagaactttgctaagtagaaaatgctagacccggccagtcacggtggctcatgccctgcaatcccagcactttgggaagccgaggtgggcgaatcacgaggtcaggagttcaagaccagcctggccaagatggtgaaaccccgtctgtactaaaaatacaaaaattagccaggtgtggtggcaggtgcctgtaatcccagctactctactcaggaggctgaggcagagaattgcttgaacccaggaggcagaggttgcagtgagccaagatcatgccactgcactccagcctgggtgacagagcaagactccgtctcaaaaaaagaaagaaaatgctagacctccatgaggggcagtcacatgtcatggccagaggccaccgaggtaagggagcactccacaccacagcagacagcactgccctgagggccccagggcttgggctctagaccctgagcggcctctggaggccttcggatgctcatctattaaagcaaagggctggagctcccttccagccgggcactctgtgctgttccaagctgcctatgggtggtggggtggtggtatttccctggtcactccccaccaggcctgggcccctggacacccttagcagaggctgtgtctcctctgggcacttgtcccaccccttgaggaacccacaggcttagtccctcagcccacccgagctccttgacacgtttccaggaccataggacagtgcggtgcaggtcgtgcagagtggcttctaggtctgagccggcactcgagggcggggtcctggtcggggggatgggggctcagcatttccccacactggggcaaggcctggcctccactgtgcgtgcacaggactgaaggccccttcccagctgcatggagatggacgtccctggcccaaaggagcaatgagacgccctccaagtgccctctgcagctgaagaaaaaggccctgggtcttgggtgcccagttgaatacaggacaccattcagattggaacttcagataaacaatgagtacatttttagtataagtatgtcccaaatattgcacagaatatacttatactggaagtatttgttatttgtctgaagttcaagtttgactgggaatcttgtacttttctttttcttggtttgtttttgagacggagtctcactctgttgcccacgctgggagtgcagtggtgcaatcttggctcactgcaacctccgcctcccgggttcaagcgattctcctgcctcagcctctcaagtatctaggattacaggtgtgcaccaccatgcctggctaatttttgtatttttagtagagatggggtttcgccatgatggccaggtcggccttgaactcctgacctcaagtgatccgcccacctcagcctcccaaagtgctgggattacaggcatgagccattgcgtctggccttgtatttttatttctaagtctggtgactctaccttggtcctatcccctggcccacccctcagtccctgctgctaaaatgtcccacagaggctgccggtgcccagtgggcgccctcccaagctttgagtgtctctgtgaatctgtgtgctcctgatcttgcaggctctgtttctctcacttctgtctgcttgagtctcgccctcctgtcccctgctgtctacctcagacagtccctcctcagcctccctctgcgttccctgctgtcctgcaaggtgacgctgagcaacatgactagtacacctggtgctgaggactcaggctccccaaagggccagcctgcacagccaaagggggtcccctgagggtgagaggagcgtaggggactggtccctgcttccctggatatggggaaaacccaggactccaaactccagcccctcccactccagccacctgggagagcccgcttcacctgggaacaggttctaccatccagaaggcaatcaggcacgtgccctaaaggggtaagccctgtcccttctgtcctgggagaggggcaggcagcaggaacagccggtccatggctgggctcccaggtcccacctgcctgtggcagagctgacgagggctgggaacagagggcttcaccagacctgtcccacccacggccctcagctaagcaacagaagtgagctccctcttccctgatgacccaggaaaggggctaggacctggcaccactgggacaagcctgggagaccagcactgtgctggcttcctggctcatgtgactttatttttattttattttattattatttttcttgggacggagtctcgctctgtcgcccaggctagagtgcagtggtgtgatctcgattcactgcaacctttgcctcccaggttcaagtgattctcctgcctcagcctccagagtagctgggattacaggcacctgccaccacacccagccagttttttgtatttttaatagagacggggtttcaccatgttggccaggctggtcttgaactcctgacttcaggcgatctgcccgcctcagcctcccaaagtgctgggattacaggcatgagccaccatgcccagacttgtgtgactttaaacaagttacctaagctctgtgagcctcagtttcctcacctgcaatatggggctagaaacatacctacctcatgagcatgatgggcttcaattcaatcatctaggtcaagctcttagcacagtgcacagaaatgggacacccttgaggcatatttcttctctttgtctctgccggccaggagccaattccgtatcttattacacaataattaaccaatggggaggcagggagcgccccctctacctcccaatctcagagggtcctgcagacccactgcaactccagaagtaccatgtatgggaagcagagataattttgctctcagacgaggcctgaggaggcctttcccttctgggcctgggcccaggaaacacggctggccttatggagaggagtctggggaaggagaccctcccctggggggatcacattacctgagtgagagaagctggggaaaaagctgggggcgggggtgggagggtgttgggggtggtgccaggcccgcatgcctgtgtgccttgggtgtgtggcccagcagaatttgttggatgctttgggattttatttttcttttttctctaatttcctttgaaaacatatgtttggcctccattacagaagtcctgcctatcgcagggaagcccacggcagacaacgcaaaccccagaaaagcgctggctgccgtcggctgcaggttcctgcatcttttttccaatgtgcacttcgttttaataaaaaatgggaccattttgtatacactgtttttgtatcttccttttctcactgcgtaaccttttcccatttgggaaaattctattctgttgacaatgaccagctgcatagtgtttcatcttctggctttgactgattgattcaaagcccatcctaaggacagctgagcagtttccaatttctggctgttgcgaaagagcgaatttctttaggatacattctgatgagtggtgtcttcgggtcaaaggtgtgcaaatcgaaaacatttattggttcatattacagaagctgcgcacgcgcgcgcgcgcacacacacacacacgcacacacacgcgcacacacacacacacacacacacacacacacacaaaacacactgtcataattccagcaggcgctgggccctggctgcaggcagaggcttgaggagggctgacttgggctgagctgatgtgggttggctgcctagggagcctagaaagttcttcatggggaggagagatgggatctgccctgcttgtctgtcctcgggttcgaggttggccatccccccacctcaggctgcaggggtcccgcacccgcagaaacatggacgattcaatattgatacctggggacctggggccagctgggctgggtggcagaagagagccagccttcctacctcagctttgcccccacccacctgacccacccccagcccaccttcaggcccacctgaaaagctgcttcttactgaaagcttctctgatcctcagccagaagtgcttcttccctcctgcagtacctgggacagaccccccagtgaggatgggggagacccctccctcctgggggatgggcccggggcttgaggtgggagaggagcggcctgggttggcgagacccttccttctctgggcaggaggcccagaaagtcatgttatggtgggtcttggagggtaggagctttccatgtgatcccataggcagtggggggacggcagtgacaggcggtgaggatggacagaagccgagggcaggaggagaggagacagctggaaatcccagagacgatgcggggtgtgagcatgggagagagaatgtggggcttcatagaggcggcttctagaattgacttttttgctgactgtggggtcagggctgagagaagcgtcaaaggcccaatgtccaggtgtccctagccggagaggtggggttcaaatcagcctccttcgggtccatgcagcgtggcaccatggtggctgccatgccctggctggctgacctcatgcaaggcaccgcatttcctgacctatgcacagggcataacaagcgtgcccaccttaaggggcttcgtggggtcaaacaaagcaatgggtggaaagttcagggaacccctcagtgccctgggctcacaccaccagtctctgagtctatttccttacctggagtagatgaggttaacgtgcctgccttgcaggcccaggtatggaaagcattcagcacatttggggtaagagttcgaaagcctagtaactagggggcttaccccttaagcccatgggaactgctgtgggatccccgtggtcagcctggggttgacatctggggtgttgcaggggcgccccctgaggggctgtgcactgtcagccagggagggcctgccaagttatgatgtcctgccctcagagacatgggtagggaggaggctaggaggggagggaccccgcccctagcagcctccggagactgaacacaggcccaggtgcccacccagcagagagctgcccccagcttccagccctgggtccagcaggatgcagaagcagcccctgcccactggatggggggcaggtggtaggggtgcccaggtgcccctgtgcccttctgccagccaggcctggaggccccaggagtaacgagataatcacagcaattgcagcgagataggactgtctgcttgtggagcactgagatgctggagcaggcggggggccgggagagtggcaggaagcttcctcaggcagagtcgctcgtcccaccagccggggtgccaggactctcatcctggaaccctgcactcccacccagccctagtcttggtgtccaggaagggctctgaggccttttgctcaaatgagcccatcatctaatgagggagaggagtgtgggtggggagctctgcgggctgcctggaactgactgtttagagttcaggttatctttgtttaccactgagaaaacataaagctgaacacaggtattaactgtgcccacctgctcctgccattgattcgctcatccagagttgcagcccatggcaccagcaataaaggaaattgcttttgaagttgacagaggctgggaatgaagctccaagaccgactggcccgtctcttccaggtggcagctgggtccctccccacccacctgtcccccaaagccaaagacacgtagttgtcaccagggagctgggaagcagcctccaatcctgacgtgtgtttttttccaagagaccctctgctgcccaggattataggctcacacctataatcccagtactttgggagatcgaggcaggaggatcattcgagcccaggaattcaaggccagcctgggcaacacagggaggcccccatctctacaaaaaaataaaaaattagccgggcatggtgacatgcatctgtggtcccagctactcgggagactgaggtggggggatcgcttgagcccaggtccaggctgcagtgagctgagattgcaccactgaactacagcctggatgacagagcaagaccctgtccccaaaataaaaataaaacaaaagaccttgtgcctatgtctcccagcccaacacggggccatctgccagggctgcagcatgagggcatgaggagagatgctaagcaggacttcctgaggaccagcatctgcagcatgaggcagggtgtacactctcttcccgacagttctctgggaaagcagtgtcaggcctggggaatcagaactggacaagaggccttcctgccccaggcacgtgctcatctgcaagccttccaatgacctaagtaggggaacctgctaagatgttcctccaccaaggggcttctctgctttcagcacccagactcccacttccccaggtcgaaggacctcagagaggcagatcattaccccaatgcctcccagctccgtctcccacacccttgccctcgtcacaccgggccacagcgtccctgtgcctgcagactctttccctactgggaagccagggtcctcgcctgggttctccttcttcaaggttggtgtagtggagtgaatggtgtcctccaaaagatacatacacatctggatccccagaacctgtgaatgggaccttatttggaaaaagggccttttgcagatgtaattaaattaaggattttgagatgaggaggtcatcctggattatcaggtggttcctaagtgcgatgacaagtgtccttataagagacacacggggagatggacacagcagagcaggagacaaggtgatggtgcagacagagcctggagtgacgcgtctaccaggagcgccagggactgccatagctcccaccagccaggagagacccctggaacagacacactcagcaggtggggaaggccctgcccctgcctcgattttgaacttctggcttccagaactgtgagaaccaatttctgttgtttgaagcccctcattgtggtcacgtgtcatagcagcttcaggaaacaaatgtagctggtgttctgggatgtcacccacacccccaacgtccacgacagccataaactgttgatggcaagtctgtccctccaggatggtgtccatccaaatttcagatctctattcccagtggcgccgtgggcagtgtggtataatatgaaaaatatctggtctttgttcctgggtcctggcacagagttcccaaacccttggaattttctgagtgatggaagcctcttttgttattgataagaagccctttccataccacttgagtttctgctaatgaggtgacttatggtcaaaggcagttctgcactcctaccgatgctccctttaagtacatgcaaattaaggggcagattatgcagacatttctagaaaaggggtggtaacttccaggtcatcaggtcattgccatgggaaggggtggtaacttggggatcttgccatgaaaggggtggtaacttccggttgttgcatggcaacagtaaactgcaatagcatctgtgggtgtgtcatatgggcaggtgctttcgccccatttctattgtagctagagtcgtcaaatcaattcggtgtggtgtcccagcccagcctctggagtcaagtttcacctcctgagtggagtcctgcctcctacctcaggaagattgagcccaggtgttcaagaccagcctggacaaaacagccagacctcatcatgaattagagtaggctccgccatctaggtttgtgtaaggacaccctgtgatgctcacacaatgacaaaatcacctaagcatgcacttctcagggagtatccctatgactactcccttttgtggacattcgggttgtcaggtctatttctgaagcacccggaaacagtcagttctggcattttagagaggttctgtatctgcagccttgttctgtgcaagcctactgggtgtctctttcagaacatatcccgatttcggagaaatcccccaccatcctgtccatgatcgagggcaccaagaactgatgcttgagccagacactcaaccacaaactgcacttcagggaggcccacagcctttgaggaggtttggagtccgctgcctaattagggctcttcatcttggtaggtaacacaggagggagtggagcctggggtttaggaagtgtggcaccgttagcatacacagaggaagctcataagtgctctgcaggagcccaaatggtgctgaggtctgtttcatacgaagagtctcggaggccaggattcagctgaggagacagattcctgtcctcgggtctccctgccataactctggaagacaaccttgaaccagtggatatgattcttgtaggatattaaatatgtctcttttcacagtcatgctatttatttactcaacactttttattttttttgagacagagtattgttctgtggcccaggctggagggcagtggcacaatcttggctcactgcaacctccgcctcccggttcaagcaattaccatgcctcagccttccgagtatctggggttacaggcctccgccaccttgcccgggtaattttttgtatttttagtagagatggggtttcaccatgttggccaggctggtctcaaactcctgacctcaggtgaggatctgcttgcctcaggctcccaaagtgctgggattacaggtgtgagccacctcacccagccttttttttttcttcatatagggtgcaaaggtacattctctcccgctcttattatcacaaatgtcaaattatgaattaaagatgttttattgtagctgctcttgcaatgtgaatgtgtgtgtgtgtgtgtgtgtgtgtgtgtgtgtgtgtgtgtgtgtgaatgtgtcatatttgcatttgggccggacctgaatgaatgactttagaatgagactctaatgaggatgacacaggcggctttcgagggatgagacctccccggagaaggacagagacattatttggctgtcttctttccggagggtaaggatttggctaagaattttaaacactcacgtcctccagctcacaggagtgggtcaagagcagctagagggagtgcagagaggccggtgtcgatgttccagaaaagtgagacgagggatgtggtcgatgactgccctgccagccgggtgcaaataatgcatgggaaggtatacaagtccggtggaaagaaccctgggctggcgataaggagattggcctgtgaccttgggtgagttctgtttggctttgagcaagtcgcttaagctctctgtgctgaagcatgtgaccgcgcatggaaaacaggccagagatcggcctccgtacctcaggagactgagtgggttgttaggtacaaaatgcctgaagtcctttccacagcaaggcagggcatacacagacctatcaataaaactgaaggcatcaggaatcctggtggggaaactgaggcccagcccaggaaagccctgtgcccaaggatccggggattgtctccatcctgcctttagggaaaagcaagctacccatctagggtctgggtagagcaccccgggaagagcaaggagacatcccagatggaggccctgccaggaacacaggccatttcccttgcaaagatgaaattcaaatctgaggtggcatcagtgccaggggaggcagctgggcacagatgtgtcttgggaggatctgggggcagcggatcatgtcacatgagagcaccggaccaggattcggcctgacccctccctcctgtgactctgagccctcaggctgtgggggctgactgtcccaccgcccaggtcattctcggcactgccccagagccatagcggaggcagggctggcataaagggggccctgggacgaccccaggccctaaggcctccaggcctgtccgggccgcccagctagggaggctgagatggccgctcggccccagccagcatatgcattagtaatggccactgatcctgctggccccgcgccctgtttccagagtggggcagtaatctgagcccggctgcccactgcctccaggctccaccctacgttgctggggccattgaatgcctctacttttccttgttctcagctctgcatcgaaatgaagagaaacacaaaccagcgatgtctcctcaacgtcctgggcgttagctgttcccaccatcacttcatagagaggtttctggatgggaagcgttaggaaagacccagggaggcctctgaggacaccttgcgcagatgtgaggccttcctgggctgggcctcagtttccttactgggggtggacaggtctgttctgaggctgtcactggcactgatgttctggggtcctggggcccattgcttgccctaatgtggggggtcactctggtggaggggacccggtcagaccatagcaggctagaccgtgtgtggtgacagcaacacggcccagtggcagaggctcctgggggtgggggcattaggggatgaagcaggcctggaggatgggtggatccagagagcactggtgagtggggggggtgcctcagctcagggggcaggcctgcgggatggggggacccctgggacatttatccagcctgagactggaggcagctcttcttaccttcctgggaagggccttcagccctgcctctccccctgcacccacctggcaaacctttcactcccagcagctctgggatgtctctcgagggacccaggctccgtcctgagcctgtggcctgtctccggcagctgcccttgggtgggaaggtcctggctggccccagaggtttttcctaagagcctgtaattctccccggagagataaggcatggttacatggactcatatcacactggcagagaaagcgcctccaggaattaggccaccagccaggggatgggcaggcctgtgtaggaagggcagcctctcagttggaggaagtgggggtgtgggacagccgagggcactgagaaagtggggaagaccacatcttcatgggagggtgggaccagcccaggctgtgggagtggcctgctgtgtgacctcagagaggccacgatccctactagctgcctctaggaaaggaatctgagcatgaaggagtagtggggacagggagatttgcttttcactatataattttttgcaactttttgaaaaaagtacattttttttttgagagtcttgctctgtcgcccaggctggggtgcagtggcatgatctcagctcactgcaacctccacctcccgggttcaggcaattctcctgcctcagcctcccaagtagctgggattacaggcatgcaccaccacgcccggctaattttttttttttttttttgagacagagtcttgctctgtcacccaggctggagtgcagtggcaccatctcagctcactgcaagctccacctccctggctcaagtgattcacctgcctcagcctcacgagtagcttggattacaggtgcatgccaccatgcctggctaatttttgtatttttagtagaaacagggttttgtcatattagccaggctggtcttgaactcctggcctcaagtgattctcccacctcggcctcccaaagtgctgagattacaggtgtgagccactgaacctggccagctgattttttgttgttgttgttgtatttgttttgtagagatggagtctccctatgttgcccaggctggtcttgaactcctgggctcaagcaatccactcacctcagcctcccaaagtgccaggattacaggcataagccactgagcctggcctctttgtgaaattttgtactgtgtttatgtatagcctatttaaaaacagtatttaaaaataatggctgggcagggtggctcatgcctgtaatccaagtgctttgggatgccaaggtggaagaatcacttgaccccaggagttcaagagcagcctgggcaacaaagttagactaatctctccaaaaaatttaaaaattagcagggcatggtggcacgtgcttgaggtcccagctactcaggaggctgaggcgagaggattgcttgagcccaggaggtcagaggctgcagtgagctgtgatcatgccactgcagtccagcctcggcaacagagtgagaccctgtctcaacaacaacaacaaaagaaatctaaacaggcaatcatttcatatattatgacaaaatgatggtctaggcacacaccatcaggatataccatccggatgtatgagaaagcaacagtatttgtcttagtctattttgtaagagaatacctgagaccaggtaacttataaagaacagagattctttttttttgagacagagtcttactctgttgcctaggctggagtgccgtggcacaatctcagctcattgcaacctctgcttccccagttcaaacaattctcctgcctcagcctcccaagtagctgggatcacaggtgcccgccaccacacccggctaattttttgtatttttagcagagacagggtttcaccatgttggccaggctggtcttgaactcctgacctcaggtgatccacatgccttggcctcccaaagtgctgggattacaggcgtgaaccactacgtccagctaggaacagagattcatttcttacatttctggaggctggaaaatccaaggctgagaggcctgcatctgggcctctggctgtgtctgtcatcccataacaagaggtggaagggcaaaaaagcatgagagagaaagagagagagagagagaaagcaagagagtaccaaacttgcttttataataaacccgctccgctgataaggacattaatccacacacaaagtcagagcccttgcaaaaggtcccagtctcaacattgctgcactggggattaagtttctgagacatgatcattgagggacacattcaaaccatagcagtattttaaacaatatggtgcccagcaaaataaaagcttcaataattgaaacaaaatgaagagtttggaagtagagctaatgaacataaatatttgatgtgagagaaagcacgtttgaaagcaaggaggtaggaaaagtgaatctctatccatctctctccctaggtccctaggtaacctcattcaattccacaggctttcaatattatctgtgtgcgaatgactcccaaactggatatatccacaaggccttgcccctgaacacagcacccatttctataatttcctgcctgacattttcacctgctgagtgatcctcttaaactcaccatatccctccctccccaaattcctcctgtgcctcctttctcatctcagtaggtagaattctcactacctggttgctcaaatagaagtccaggcttcatcatcaattcttctttctctccccagcacatccactccaaagcaagcccgccccctccattggcccatccttgcccaggccaccacctctccagcctggattgtgacactgccctctggcttccatgcatgctctctatctcctctctcctctcctctcctctcctctcccctccccttccctcttctctattcttttcttttctttgatggagtctcgctctgtcacccaggctggagtacactggcactatctcagctcactgcaacctccacctcctgggttcaagcgattctcctgcctcagcctcccaagtagctgggattataggcctatgccaccacacatggctaatttttgtatttttagtacagatggggttttgccatgttggccaggctggtctcaaactcctgacctcaggtgatccacctgtctcagcctcccaaagtgctgggattacaggcatgagccaccgcacccagccaatatattttccatacggcagctggagataacatcaacatattttcagtcaggcaaggtacctcatgcctgtaatcccagcactttgggaagccaaggcaggaggatccttgagcccagacgttcaagagcagcctggacaacatagagagaccctgtctctattaaaacaaactagccagctgcggtggtgcatgcctgtagtcccagctacctgggaggctgaggtaagaggatcacttgggcccaggaggttgaggctgcagtgagccatgatcatgccactgcactccagcctgggtgacagagtgagacactgtctcaaaataaattttaaaaataaaataaaacaaaatgtttttcacatccacttttacctggcctggctcccccccacccttctgaaccccacttgccatcgatggcattctgaaggttcattgcctctgggtacaaaaaccttcagagatgcaaacaaacgcataatttgaaaatctgctttggggatggctcccaaaagcttaatcaggcctataagtttccgggcctttccttgtcatttctgtgtatctgttaagggtgaagcaggggttaaaaactgtacttccaccaggcgcagcggccatacctgtaatcccagcactttgggaggccgaggcgggcggatcatgaggtcaggagatcgagaccatcctagctaaaacggtgaaaccccatctctactaaaaatacaaaaaattaggtgggcgtggtggtgggcggctgtagtcccagctactcaggaggctgaggcaggagaatggcgtgaacccgggaggtggagcttgcagtgagctgagatcacgccactgcactccagcctgggcgacagagcgacactccgtctcaaacaaaaacaaaaacaaaaacaaaaaaagtgtactttcagccgggtgtggtggctcatgcctataatcccagtgctttgggaggccaagcaggcagatcacctgaggtcaggagttcaagaccagcctggccaacatgatgaaactctgtctctactaaaaatacaaaaattagccaggcatggtggcagtgcctgtaatcccagctacttggagggctgaggcacaagaattgcttgaacccaggaggcaggggctgtggtgagccaagataatgctactgcactccagcctgagtgacagagtgagactctgtctcaaaaacaaaaaacaacaacatcaaaaacctgtagtttgtggctcacgcctgtaatcccaacactttgagaggccgagagggaaggatggcttgagatcaggagtttgaaaccagcctgagcaacatagcgagaccccgtctttaaaaaaaaaaacctgttctttggtccttgttggggcttcagaattcaggtacattgtagaatgggggtgggaggtgtggggatgatgacatttcgcctctttcatactctagtgttgttgcttttgagaaaaagtccggctgggcacagtggctcatgcctgtaatcccaacactttgggacactgaggcgggcagattacaaggtcaggagatcgagaccatcctggccaaaataagtgaaaccccatctctactaaaaatacaaaaattacctgggcgtggtggcgtgtgcctgtagtctcagctactcaggaggctgaggcaggagaattgcttgaacccgggaggcagaggttgcagtgagctgagatcacgccactgcattccagcctggcaacacagtgagaccccatctcaaaaaaaaaaaaagaaaagaaaaagtcccgtgaggccagggcaaagctggcatcagtaacaaagactgaatattaaaaatagcttcatctccacaccaccccactccactgagcagccacgtttaaatgtaagaaattctttttaggctagtctcagtatccattcttaacacagaccattgtctgagaagaacattttcctaaaagaattgaaacaatatacgttggagacactgatttttctaaacgtaattgcagtgttttgggaggctaccacattttttgaagatagattggccaaaactcagtttcataaattctatatgattgggttttctttctttctttcttttttttgaaacagaatctcgctctgttgcctaggctggagtgcagtggcgcagtcttggctcactgcaacctccaccttccgggttcaagcgattctcctgcttcagcctcctgagtagctgggattacaggggcctgccatcatgcccagctaatttttgtatttttagtagagacggggtttcaccatgttggtcaggctggtctcgaactcctgaccttgtgatctgcccgcctgggcctcccaaagtgttgggattacaggcatgagccaccgtgcccagctgggttttcttttttaaatgaacatgtgctttaatgagtgacatattttaaaacctatcttctcatgtcataaaatgtgacttgaaaatactgttccaattataattaaccttcattttattttgtctaataaagtgtttaatattttctcccatcaggaaaaataaaattatttgccagctgactaatagttcttatgcttttcttttttattaaagttactataaaagttagatcatgatgtctaacacaattaacggcattatttctgactttctttttcctttttttttttttttttttgagacagggtcttgctctgttgcccaggctggagtgcagtggtgtgatctcagcttactgcaatctctgcttcccaggttcaagcgattctcccacctcaggctcctgagtagctgggactacagaggtgcaccatcatgccggtctaattttgttttgtatttttagtagagatggggtttcaccacattgcccagggtggcctgtctcgaactcctggactctagttatcctcccatctcggcctcccaaagttctgggattacaggcatgagccaccacacctggtcttgttttttgagataggatcttgctcccaggctggagtacagtggcacaatcatggctcactgcagccttgacctccctggctcaagctatcctcccacctcagccccttgaccacaggtgcaccacacctagctaattttttattttttgtagagttgggggtcttactaggttgcccgcactagtctcaaactcctgggctgaagtgatcctcttgcctcagcctcccaaagtgttgggattataggcgtgagccaccagcctggccccctgattttctaatacaagatttttgttaattattccccaaagggaaacccagagtatgaaacacacttgagcacacatttattgaaagaatactataccttcttcccataaccttcaagtcataaattatttatcatcttagtaacacattaaattgcacagatacacaataaataatgagtgtaaggacaaattgtccaaaacatggaaataaggcaacagcatggctgtcttttcacccctgccaccttgaaaaaaatttttaagtagaaatgggatcccactttattgcccagactggtctgaaactcctgggctcaagcgatcctcccacctcagcctcccaaagtgctgggattgctggtgtgagccatcgtgtccaccgtgggattactcagttctctaggagaaggtatctgtgtttgactgcttgactgttgcttagggaccacgctctgtgaaggtacttgtgaacttgcatatttttgctcaggagagatgcaaattatttctgttgtgtagagaaggtaacctcaaagattacagttgtgtgtgtgtgtgtgtgtgtgtgtgtgtgtgtgtgtgtgtgtgtgtttgagatggagtcttgctctgttgcccaggctggagtgcagtgccatgatcttgactcactgcaacctccacctcccaggctcacgcaattctcctgcctcagcctcccgagtagctgaggctaaaagtgtacaccaccacacatggctaatttttgtatttttagtagagaagaggtttaactatgttggccaggctggtcttgaactcctgacttcaagtgatctacctgcctcagccttccaaagtgctgggattacaggtgtgagtcactgtgcacaccttagtttcctaacccttcggaatatgataggttaggcaagattcctgtaagtgaaaaaataacatgtataatttacagctactcaataagtcttagttaagctttcttggtatacttgccggaagttgatgaagggaattaactttagtgattgagtaaaaagaaaattgctttgcaagtcaggtgagttctacttcttagcttccagcaaattagaagagaactgaatagatttctcagcaggtagatcattaaaaataatttgtgatgatagattacgctttgattttggctataattcagaaaaaattcaggaaaccaggaggcagaggttgtaatgagctgagatcacgccactgcactccagcctgggtgacagagcaagactcctcaaaaaaacaaacaaaaaaaaaaaaaataaaaaataaagattaaaattattcctgaattttgtcctattaaaccatggatataaaaactaataataaaacaaacaaacaaacaaaacaaacaaacaccccaaacaccccaatcctttcattaagagagacatttctgtttttgtttttttgttttgttttgtttttttgagacagggtctcactctgtctcacaggctggagtgctgtggcgtgatcttggctcgctgcaacctctgcctcctggctcaagcaatcctcccacctcagcctcccgagtagctgggactacaggcatgtgccactacacctggctaattttttgtatttttgtagagatggggtttctccatcttggccaggcgggtctcgaactcctgacctcaaatgatccgcacacctccgcctcccaaagtgctgggattacaggtgtgagccaccatgcctggctcagaaacattttataacagatttattgagatataattcacattcacgacatccactcttttgaagcaaacaacttagtgatttttcgtatactgtactcacacagtcatgcaactgtgatcactatctaatattagaacattttcatcacctcaaaaagaaacctgttacccattggccatcatttctcattctcctctcagcccagttcctgacaaccactcatttactttctgtctctatggatttgcctgttctggacatttcatataaatgaaatcatacaaatatgtggcctcctgtgtctgaattctttcacttagcataatgtattcaaggtccacccatgttgtagcatgtagtactattttttattccctttaatgactgaataatatttcattatatgggcgaattttattttatttatccattcatcagttgacatttgggttttttaatgagctattatgagtagcattgctatgaacactaatatacaagctttcgtgtggatgcatgttttcaattcacttgggtatacacataggaatgaagtttctgggtctcatggtaactctgtttaacctttgagaaattgccagactgtttgccaaggtgactgcaacattatacattcccaccagcaatgtatgaggattccaatttcttcacatccttatcaacacttgttattgtccatcttttttattatagccattctagtgaatcttttttttttttttttttttttttttttttttttttttgagacggagtttcactcttgttgcccaggctggagtgcaatggtgagatctcggctcactgcaaccttggcctccgggattcaagcgattctcctgcttcagcctcccgagtaaccaggattacaggcatctgccaccacgccttgctaattttttgtatttttagtagaggcagggtttcaccatgctagtcagactggtctcgaactcctgacctcagatgatccacccacctcggcctcccaaactgctgggattacaggcatgagccaccgtgcctggcctctagtgaatcttattgtggttttttgtttatttgtttagagacagggtctctgtctgtcaccccagctggaggctggaatggagtggcaggatcatggctcagtgcagccttgaacccctgggctcaagagatcctcccacctcagcctcccaagtcgctggaactacaggtgtgcaccaccatgactgactaattattgtggttttgatttgcatttctgtaatgactaatgatattgaggatgttttcatatgcttattggccatttgtatatcttctttggagaaatgtctcttcagatattttgcccatttaaaaaattatgttatcttttattgttgagttgtactagttgtttgtattttctggatactaggcccctattttaggtatgtgatttacaagtattctctcccattctctgggtcgtcttttcacctttttgatactgtccttaaagaacaatagtttttaattttgatgaagttccaaattatctatttcttctgtggttgcttatgcttttggtgtcatatttaagaacccattacctaatccaacaaagatttacaactatgttttcttgtaaaagttctacagtttatagtgttagcttttgcatttaggtctctgattcacttttggttaatttttgtatacaatgtgagatagggatccaacttcatttgtttgcatatgtatagccagttgtcccagcactatgtgttacttttttcaaaaaaaaaaaattgagaaaggctctcactctgttacccaggctggagtgcagcagcatgatcgtggctcgctgcagccttgacctcccgggctcaagtgatgttcccacctcagcctcctgagtagctgggtctacaggcatgcgccaccatgctcggctacttttttatttattttatttatttatttttatttttattttttgagacagagactcattctgtcacccaggctggagtgcagtggtgcgatctccaacagatgtcttccaacagatgaagaaggaatatcttattaatatttatttaggtctttacattatttcaatgatgttttacagtttcaatgtcatattttgctttttttgttacatttattcctaagtattttattatttttcatgttactgaaaatggaattgagctagacaaagcagctcacacctgtaatcccagcactttgggaggctgaggcagaaggatcagttgagcccaggagtttgagattacagtgagctatgaccatgaaccgcactccagcctgagtgacagaaagaaaccctgtctctacgaaaaagaaaaacaaaagagaaaatagaattgtttccttaattttatttttggtttggtcatttctaagatgtagaaataagacaattgatttttgtatattgatcttgtatcctgcaactttgctaaacttcttcattctaacagaacttttttttttttttgagacagtcttgctctgttgcccaggctggagtgcagtggctcaatctcggctcactgcagcctctgaaccctgaaccctggttcccatgttcctcctgcctcagcctcctgggtagctgggattacagctgacctcctgacctcaggtgatccacccaactcggcctcccaaagtgctgggactacaggtgtgagccactccgtcagcccattcgaacagatttttaatcagtctattccttaggactttttatatacaagactgtgatctgcaaatagagacaattttatttattcctttccaatttgaatgctttttatttaattatcttgcttaacctccctggctagaacctctagcacaatgttagatagaagtgataagagcagccaggtgcggtggctcacgcttgtaatcccagcactttaggaggctgaggcgggtggatcacctgaggtcaggagtttgagaccagcctggccaacatggtgaaaccccgtctctgctaaaaatatgaaaaattagctgggtgtgctggcaggcacctgtgatcccagctactagggagcctgaggcagaagaatcacttgaacccgggaggcagaggttgcagtgagctgagatcaagccattgcattccatcctgggcaataagagcaaaactctgtctcaaaaaaaaataataaataaataaaggaagcagtaagagcagacatccttgtctcattcctgatgtaggggaaagatttcagtctttcaccagtaagcattatgctagttgtgagttcttttttacaggttgagaaattttccttctattcctagtttgtcaggtgtttttatcattaaagggtgttgaactctgtcaaatgcttttgctgcatctattgagatgattatgtgggttttgtcctttattctagtaatacaatgtattacattaattgattttcacatgttaagccaaccttgcattcctgcgataaatcctgcttggtcacggtgtataatacatttcacacgttagtggttttggtttgccagtatctcactgaggattcttccatctatattcataggagatattggtctgtggttctcttttcctatgatatctttgtctgattttggtattacaatactattagcctcataaaatgagttgaaaagtgctcctttctcttctatcttttggtaagagtgtcaaaatttggcattatttcctttttaaattttgggtagagttcaccagtgaaactggtttggcctgagcttttctttgtggacagttttcaaactactaagtcaagctttttgttataggtctatccagatattttatttcttcttgagttgttagtttttatgtctttccagtaatttctcaatttcatctaagttgtctaatttgttgtcttatggttgttcatagtattcccttttcattttttctttttagtttagagacagggtgtcactgtgttgcccaggctagtctcaaactcctggactcaagctatcctcctgcctcggcctcccaagtagctggaattacaggcatgtgccactgcattgagctccatcttttttatttctgtaaagtgaggttgtaatgttccctctctcattcctgattttcacaattttttttcttttctctttttcccccctttagttagttagtttgtattttgcttggtcagtctagctaaaggtttgtaaagtttgttgagcttttcaaatagtcagtttttggtgtggttaatttcctctatttttttttaattttctatttcattaatttctactgtaatccttattatttcctttcttctgtttgctgggggcttagtttcttcttctttttccagtgtcttaaggcagaaacttaagattattgatttgtggttgttcttccttttaaatatagacaggtacggctataattttccctataaatactgttttagttgcatcctatacattttggcatgatgagtttttatgttcattcatctcgaagtatttcctaatttcccatgtggtctattttttgacccattgattacttatgagtatatgtttaatttccacatatttttgaattttcctaatttctttctgttgttaatttcaaatttcactccattatgaacaaaaaacatccttggtacaacttcattccttgtaaatgtattgatgctagttttgtggcctagcatataatctatcctagagaatgttccatgtgcatttgagaagaatgtgtattctcttgtttttgggtggagtgttctacagatgtcagttaggtctagttggtttatagtgttgttcaagtcttctgcttccatatggatcttcttcctatctacctatttagttctattattagttctatgtattattaaaagtgggatattaaagtctccaactatattgtgaattgtctatttttcccttcaattctgttttctgcttcatatattctgcggctctgtttttaggtacatgtttataattgttatatttttctgatggattgatctttttatcatcatacaatgtccctcattacttctagtgacatattttgtttgtttgttttgagacagagtcttgctcgttgcccaggctggagtgcaatggcacaatctcggctccttgcaacctctgcctcccaggttcaagcgattctcctgcctcagcctcctgagtagctgggattacaggcgccggccaccatgcctggctaatttttatatttttagtagagatggggtttcatcatgttggccaggctggtctcaaactcctggcctcaactgatctgcccgtctcggcctcccaaagtgttgggattacaggcatgagccactgcacccagccatattttgttttaaagtctattttgtctgatattagtaaagtcactgcagctttcttatggttaccatttgtatcattttctattaaaattttttcaaccgatttgtatgcttaaatctaaaatatatctcctataaatagcatatagttgaatcttgctctattcatatttttgaagctgattaaggcagggcatggtggcttacacctgtaatcccagcagtttgggaggctgaggcaggtggatcacctgaggagttccagaccagtctggccaacaaggtaaaaccccgcctctgctaaaaatacaagttagccgggcatggtggtgtactcgggcggctgaggcaggagaatcgcttaaacctgggagacagaggttgcagtgagctgagatcacgccactgcactccagcctgggcaacaagatcaaaaccctgtctcaaaattaattaattaattaattaattaattaaaaaaataaggctgggcacggtggctcacgcctgtaatcccagcactttgggaggccgaggcgggtggataacgaggtcaggagattgaaaccatcctggctaacatggtgaaaccctgtctctactaaaaatacaaaaaatcagctgggcgtggtggcaggtgcctgtagtcccagctagtctggaggctgaggcaggagaatggcgtgaacccgggaggcggagcttgcagtgagtcaagatcgcaccactgcactccagcctgggcaacagagcgagactctgtctcaaaaaataataaataaataaataaataaataaataaataaataaataaataaaaataaagctgattagaagctgcgtgcatggatgagcttgtcaactgatgaccttcaccaattgtaatctgatagggcgatttcattgggaaactcctaatgttagtatctttgggtccttcctcttgagttggtctgagtacttacagaggagcccttccatttcctgcctgaatggaataagccttgctcccaggcttgtgggagctgcgttagggagggagaccgtgataccattctgcacattaactgtcactttaaacctagatttttggtatggtaatttcccctcagctgtgttcatatcccctcctagcagaatcctctagtcttctgctcagctgggaacgggtcagtagcctgggtacacagaagtggggaggagctctagatccccaaaatgtcttaagctttctttctttcttttttttttttgaggcggggtctcactctgtcacccaggctggtatgcagtggcgtcatcacagctcactgcagcctcaacctccccgggctcaggtgattctcccacctcaggctcccaagtagctgcaactacaggctgtatgccaccacacctggctaattttttttgtagagatggggtttcgccatgttgcccaggctggtctccaactcctggcctcaagtgatctgcccacctcagcttcctaaaatgctaggatgacagtcatgagccaccgcacctgctgtcttaagctttcaacttgacctcctgttacagtccttcgtttacccctcactgatcagaggaacctggaaccactgatctttggggtggcagtttgcagtgttttgtttttaatctattaagttagctactacaagtacacctgttttctagttttcaatgggttgtttgtttgtttgttttacagacaaggtctcactgtcccccaggctggagtgcagtggcgcaatcatagctcatggtgacccagaactcctgggctccaacaacaagaatctttttgttgttgtgctattgttggtttgccaatgtctaatcttccttactttttatgtctgtgggttatgtgccttgcccacttttgtaaccctctactgtcattttagtggggttttgatgtcagaggagtgagattaacccgcatggtcaattggtcatctttttttttttttttttttttttggagacacagttttactctgtcagcaggctggaggggagaggcgcgatctgaactcactgcaacctcacctcctgggttcaagcaattctcctgcctcagcctcctgagtagctgggattacaggcacctgccaccatgcctggctaatttttgtattattactagaaacagggttttgccatgttggccaggctggtctcaaactcctggcctcaagcgatccacctctcctggccttccaaagtgctgggattacaggcgtgagccaccacacctggccattggccatctttaatcgaaggccaccttcttctatttaaagctttggtttagatttattcttttatctgcacttttggaagtctctcttcctaagtgtcaagataccgcttttcccattttggctactgcagactctaagaggacatggtaaacttgggctcataactgcacctttctgttcctcacctgaatactaaagatgtgtattagtcaggattattgattgcaaatgacaggaaggagcttgacgttttcccctgaaggagaagtccagggaggttctcaggcagcctctctgcaacctggttctagtctcaccagctttgagctttgcagtcccagagggaaaaggctcttcactttcccaatggtttcaacagaagccccagtcatgtgctactctctgaacggagtaggggacctgactggctggctgggtcagagggccccaccactgcggggagggggagttttggagttagcttccaagaaccacttggatgaggtgagggaggcagggttgttccctcaaatagcattgcagtactgataccagaagaagggggaacagatgctgggtaggcagaaataacaggtgtccactgcagggttatcataccagcctcatggccttgctgtaagttaaacccttagctgggtgcctgaaacattaaaacactagctgctgttgctgttgttatgactgtcactgttaacagggagactttgtggctcgcctttttatcctgaacaacacattcctttgctagggccagaaacaggcacagaacctgtttccctcggccttctggccatgcagttggcagcgaggctcagcaaagcctcctgatcccatgctcttctctcagttgggtctcctctccttatcatccctgcctcctcctccaggtgtcacaccttggcctcacccttctcactgaaagaacacacatgtactttgccacgtacttagccgctatcttggagtgactacttggagtgtgggtgttgtagctttgtgatggttgctcaaataagttataaactgctggggattgggccagggtcttacatgcctccagctaaacccctttctccaaggcctagaatgcaaacctggccacacacaggatccagtaagtcccaggcaattgaggggtctagctggtggcaaggcctggagggaggacatcagatcaccgggcatttggcccatctctgccagttaaggactgaggtccactgctagtcactgtgacagagcctgttctatatgttggtaaagccaacctctcctattccttagtaatattaatagaatcctgattttttagaattgcaaaatttcaaatatagaccttaagacttttacttaaaaacagactaaaggccgggtgcaatggctcatgcctataatctcagcactttgggaagctgaggtgggtggatcacttgaggtcaggagtttgagaccagcctggccaacatggtgaaacccttctctactaaaccattctctactaaaaatacaaaaaaaaaaaaaaaaaaatagctgggtagggtggtacgcacctgtactcccagctactcgggaggctgaggcagaagaatcgcttgaacccaggaggcagaggttgcagtgagccaagattgtgccattgcactccagcctgggcaacagagtgagacttcatctcaaaaaccaacaaacaaaaaaacagactaaagaaatttttattatgaaaaatgtataacctatttaaaacagagaatggtataaagaatgccacatagccgtcattcagctttaacacatggctaaccttgtttcttctattacattcccaccccattattggattattctgaaacaaatctggacatataatttcatccataaattcagtaagtatttccaacaggtgatttttgaacatatacactagtaaatatatacatatgcacaatatcatataaaacacaatacctttatcacaaaacacaatacctttctcacctatagaaaaataatcaccaggtgtggcggctcacgcctgtaatcctaacactttgggaggccaaggcaggaggatggcttgagctcaggagtttgagaccagtctgggcaacagggtgagacctcacatctaaaaaaaccccaaataattacctgggcatggtggcgtgcgcctgtggtcccagttacttgggaggctgaggtgggaggatcacttgagccacggagattgaggctgcagtgagctatggttgtgccactgcactccagcctgggcaatggagtgagatcctttctaaaaaaaaaaaaatcataatttattcatatcataacatactacttattgtttaaatttccccaattgtctcacaattttttaaagagctgacttgttctaataagttccaaaaatgcaaggtccacgttacactagaaccccaattttattcaagggggcaatgtgcccaggtgaagaagtatatttcccaacttcccctaagcagggtgtgggcctgtggctcagttttgcccatgaggtttaagtggaagcgtggaggaggcttccaagactccttaaaaggaactgtcaggccgtgtgtggtggctcacgcctgtaatcccagcacttttggaggccgaggtgggtggatcacttgagatcaggagttcaagatcagcctggccaacatggtgaaaccctgtctctactaaacatacaaaaattagctgagtgtggtggtgggcgcctgtaatcccagctactctggaggctgaggctggagaatcgcttgaacctgggaggtggaggttgcagtgagccaagatcgcaccactgcactccagcttggatgacagatgagaccctgtctcaaaaaaaaaaaaaaaaaaaaaaaaaaaaaaaaggagctgtcggctgagagatgagcaccttttctctggagctccagccactgtattgaaccatgaggtggccttccaaatggaagtcaaagctagaatgacagacagaaagaataggaaacgaatttcccattctattcttatttccagtctttattatagaatcatttaagattaggtttagttgtaataagtagaaaattaaaaaatttatagcagtgccttaaatatgctacaaattattattattattttttgagacagggtcacgttctgcagcccagactggagtgtaatgtcacaatcttggctcactgcagccttaacctcctgggctcaagtggctctcacaccttagcctctcttgtggttgggaccacagacgtgtgccatcacgctgggctgatttttacattttttgtagagacgggtctccctatgttgctcaagctggtctggaactcctgggctcaagtgatcctcctgcctcggcctcctaaagtgttgggattacaggcgtgagccactgtgcccggcctatttttctatctcacataaaactagttaagagataagcagtatggggaaaatacagtggttccaaaaaaccacagactattaggtatctattgctgcataatggattacacccaaaacttagaaccttaaagcagcaaacccgcattcccatctatttcccagtttccaagggtcaggagcccgggaagctgctctcaggctgctgcggctcaggatcgctgatgaggcctgccgcagccattctcagctgcaccgggtccgggcatccacagccggctcacgcgctggtggtcgccaagcctcagctcttgctggctgttggttcagggcttcggttcccagccaggtggggctctccaaaggagagggcagctcaaaacaacccgctggcttcccccagagcaagtgataggagacaggaagagggagctagagagagccctgaaggtggacgtcgcagtcttcactcaatcaatctccgcagggaacgccctgcaggcccaggtatccttccggtcccttcctcctgcccctgtgctccagatcccccaggctccagccctgcagcccgagccccacccactatcctcgcctcccgccctgccgctcggccctcccgcttcaggtctctgtctctccctttctcccttcccctctctctgtatcctttactttgtgcctctgatgcctgacctggccccaagccagcaccccaccatcccaccctcttcccaccctgccccccggccacgtgcccccgggccagccagaacgctgacccctccccctgagtccactccccgctccccgctccccgcacagcccgggccacgccctacccgggtgccctccctttacccagctccttcccatccagccgggtcctgatccagccccctgctccaggatgccccctcctagcggtgtgtgaggctttcatgacccttcttcctcctttcccgacagatcagcgggggaggtgggctgagccgcccctctcgtcgtcacccctgccttggccgcccagccgtgctgggagagtttggtggccgtggctggcactgcggcagtgcccatgtcagctctggcgcctctaccgaactccctgttttgggggctctttccctaccagggtcacgtcgatgaggaatctacgtccctcccagcccggttcccacctctcaggtggggcagatgccagaggcctcccgggtccacgcccgcgggccacttggaccgccctgccccggccaaccccgccccacccagactcccgcccgcgagcgggtgccgaagcacgaagcacgtacgccccctggtggccgtggcggggactgccgcgcggactccgcagccccgccccaccccgcccgcccagcccaatcccacccgctccgccctgctcgcccctgcctgctcacctactgggctgcgctgtccacgcctggagcccgggcagcttcagttccgcggaggacaggtgtaacccacagagtgattcctttaccggggcctgctaggctccggcccacgaggcaggactggcggcgttctcacgtcctggaagtcaaggccccaaggggaccgaggcgctgcccaggctcccctgactgccagctccggcctggccacccagtccgcccccagggaccggactgggtgcgccgtccacccttccagtacctggaacattctccgcggattgggaggttctgggttctgccctagattcccaagcaaagttgctcctttgctcttgtcacttgccagcttcgtggtttttgttttttgtttttgagacggagtctcgctttgtcgcccagcctggagtgctgtggcgcaatctcggctcactgcaacctctacctccccaggttcaggcgattctcctgactcagcctagctgggattacagatgtgtgcaaccatgcccgcataatttttgtatttttagtagagacgaggtttcaccatgttggccaggctggtctcgaactcctgacctcaagtgatccacctgtctcggcctcccgaagtgctgggattataggcgtgagccaccgcgccaggcctgcttctctaaagatccctgcagcacggagaggctgctagggcccgtgcttctgaataggtagccagctgtggctattgattatcacatttttcgtggtatataattttaattaatttttaattttaaaacaagtgtaaattgttctgcaaaacaactttgttttgtaggactatgcggcactttaaatattgaaagtgtagcgtccaaattgagatgtgctttgtgaaataccccctggatttcagagttagcacaaaaataacgaatcgaaactatctcattcctttactgtgaattacatgctgaaatttttgtttgttttttgaaacagagtctcactctattgcccaggctggagtgcagtggcgtcatctcggctcactgcaatttctgcctcccaggttcaactggttctcctgcctcagccccctaagtagctgaaattacaggtgcctgccaccatgcccggctaatttttgtatttttagtagagtcggggtttcaccatgttggccaggatgatctctatctcctgacctcaggtgatccacccgcctcagcctcccaaagtgctgggattcaggagtgagccacggcgcccggcctcacactgaagtatttttgatatattgagttaaatgaaacatttaaccttttttaaaaaacgtggctactagaatgtttttaatgataaatgtagatcacattctatttctatatttctgcactaggaagtgggtttgagttaaatctagttttattttctgaccgtactgcaggtaccggaggttggggaaaccattgtcagtggaaatggggatgtgtatggggaaaggtcctgatcctcagagaccacgcccatagagtgagccctgggcaggaggtcagccagggagcatctcatagggcccaggcagcatgaggttcacacagacataggtacccacagccccagcgggcattgggggcaggcactgagcttggcacagcatgattcttggaaagaacacgtatggatggcctgaagacccaggttctagcatggttatgccactgtgtgactaagccacttggcacagcacaagcagttaatgtcctgttctactcaccgaagggctcactgcagtgagcgagactcgcgaggggaagccctcttcagccctgcccatggtggtcctctctggaggagggcatgtttctggaatcctgatttgttaccagcacataattttcaagttggcagaaatgcatcgtttagctgggtgcggtggctcatgagagcattcttatttttgtgctaactctgaaatccagggggcatttcacaaagcacatctcaatttggacgctacattttcaacatttaaagtgacacgtagtcctacaaaacaaagttgttttgcagaacaatttacactcgttttaaaatttaatcccagtactttgggaggccaaggtgggcagatcgcttgagcctagaagttcaagaccagccatgggcaacatggcaaaacccatctgtataaaaaatacaaacattagccggacgtggtggcttgtgactgtagtcccagctactcaagaggctgaggtgggaggatcagttgagaccgcagtgagccatgattatgccactgcactgcagcctgggcaacagagtgggatcccgtttcaaaaaagaaaaagaaaaagaaaaaaagaagtgcatctttaaaagccttgtcctatgcgcgtgaacacatgagtggtgcgtagcaggccctgatgcgctgcttacagaattgaggaaagcagaggcaaggctgcccacaaggaggccgcagcttcttcaaggagcctcttgccgcgtgctggctggccttggtggccaggaccccaggagaggaagctgagggaggcctgaatgccagccgcacctggcatccggcacccccttctaggttcattgccaagtaccggcagccagaagggtgtagttttctcttagggagtccaagtccgttgttgccacctctgacccctcgacaccaggtcctgggagccaagtcttgagccccaaagagctctgaggagcccaggtccacagaagtgccctttttttgaaaataaacacccttcactacataggtacacacacgcgcgcgtgcagacacacatgcacacacacacatacacacagccagagggaaatgctcctatcttttatcttctaacattaaatccctggtcaggataactattcagtcccaagacgttggggggtgcacacacagtacaccctgaggcccgagagagcaggcttgggcccaagttgcactgtccgggactcaggggggatgagcccctgagatgctacttacaaatagggctgctcagcctgccagggggctgcaaggcctctgcagctccagggattgtgggagtcagaaaaatcctttgtcttggttctgggtgggaagcgggacacccccagatccagtgtcacagccactcattcccaggaggacagagcagtcttcagagccagcaagaaagctgtggggctcagagcccactagctttcttttccaggacaacgtgcctcagaaaccccggtccccttcccaggaaaggaacaatgactcaggcaggtagtgacaagccacctgccacttgggaaacagctagactgaggctgagaggttgagtggtgctgggtgagattactggggttggtggaggggggaggtcgggggacccaagtgccggcgactgcactgagacttctcctgggaggggtttaaaagcagctgccttattgagatcaatggaatgactgctcacgtgacccatgtacctcttaagtccccttcaggctggaaagtgctctacacccccaatgctctgagtctaaaaactctaaacctgtgttgaaacgctggtgtttcgtggttaatatacagcatcctctctcagttactctatcctatgacggggcactgtttcgcagcctgggtggagttgagtcacaaggtggcagagtcagaacctactagtctagggatgtcagtttacagctcagtacccaaggtccatgaaagcccagtgaggagcctgaagttgcacagctaaaggaagggctgggactcgaactcatggctctgtggttcagtcctttggctaaagggtccatgaacgccacccacaaagaatgtattgaatgttttgcttctgggctctggaggcatccagggtagctggggggttccctgccagtgaggagggagcaggcactggcacaccattcctcagtagcccgacctcattcaatctggcaggtaggtatgaagccgggtcaaccggcgcgaatgcatcagcatgtagggaaggagaaaaaggagtttaggggaataaggagaaaacagtggaaaagagctggaatgagaacacgcgaacaaagcaacactatttcctttgtcttaaggtcctgctaacaaaaccgtctccattagactgagcggcatcgccatctggtggtaactaaaggcaaacgctttagaaaggaatcgaaacggtctaatccagcgattagcattttaccatgcaaaacccaccgttcctcatctcccaggaggcttagcacttggcagaggaccacctgtttaggcagatcagtcccagcaggaagctgcactgtccttgaactccaggccacggagtatcctcactcagcgtgagttgacagggcttagaaggtttaggcatgggggtagatagggaccttcgggctttccacggctctagtggaggagcctcacagccccgttcatagccagcagttgtgcatctgagttccaggttcaaggacaggcctctgggcagagcctcttggttattactgcctaagggtgccactcccttcccaaactaatttagtcatctgcattctaagagctgctcagccaaaagaagccagcgtctgctgctcaaaggagccagaacagagagggtattttagaaaaccagctgagagtaatcatgagggctattatcttattgatcaaggtccagccatttgccaaggtatatacacgtttatttaaaaaagtttacagttttcattatacacaactattaagaggttatagtcagaggaggcatgtgtcctgttgacagacgtgcctactagatcatcacaatgcaaggagaaaggtggaagggaggagacagggcgaggaaaaataagcgataaaaagcttcagatttcagttaggggctggcagtcccttttatcttttcaagtatcacacaatatgtaccaaatacaatctgtaaataatggccatttcttcccaagcccacagccaagatgagtgttaggctaaattcagagccctggctcttcctcagatgagtggaaaacctgcgcatgacagggccggctcccccttctcaaagggcttcctcccactcatcccatccctaacagaatcgccgaggtgttcacgggccagagaaagcacaaacatggattcagaagtccaaagaaatgcagttcgttgcgcccaatcagagatagatgatttcattcaacaaggctggaagcccagttgggaagtcgataaaaaatcttgctaacttttttaaatggcttttacttttctaagtcactgaaacaaggaagggccacatgccatttaaaatcaaacactagttcccagagacttggtgtccagaaacttgacccacagaggctagcggaggatctgtctttcatgattctcagccatcccaacgggaggcctaacataaagcatgtgccaggccaatgccaactaggacttcagggggcctttggagggaaaaattcctttgagaggagacattcctcaggagcttagatcagccagctggcagtcagaacagcttttgaagtggatgagaaatgttaggtactggagagatgatatggcaactcctgataatgacctcactaggataaaatgctggttgaaactgcacagtaacctcaaggagggtgatgaaattgacgacaaagccaaatgtcagtgtctaagatggctaccactgaccctgtgcccaaaagccccccggtgctggggcttccagagggagcccaagggtggtggattcaatgttgccaggttgcaaccatcttgcttgttggtgtttggcaagagcttgagctcagttatgtgaacaggggcaaagaatggcttgtgctggtaaaactcaagggaggatccaaaaactatgggcactaaaaaggggagggaaaccgccagaagtggctctgacctgctgccgctgccaccacctctaaagccaagaatgtagagcctctgcccagggatctggatgctctcctgagtgttggaagggcagcctggaaaggcatttggtggtgaaacaccgctgctccagacttacgctaccatctattgttgggggcccagagtccttggattcactgccaggccttcttccagatctttctgtacctgtgtgtttgggctcctactcccacctctcccaggcgcagggagaggacaaaaagcataagggactctgttcaacccagcaaaagtcagtttcccagtggagaggcaaagccccacccagaacataaacatgcatgggaccaaggttagtgcccagacaggacagacttgcacagaacaagagggcacagtgggatccatgcggcaattacaggagcttccagcactaacagaggagccttatcccaccttcatcacacacacttagatggacacacacacactctcgctcacactctcacacatgtgcacacatacacacactctctctctctgcagccacactcaaatctgctaaactcctacaacctcccccagcaggtcatttgacaattctgcatcttccgctctctggtgctggggctctggtcagaggcgagccaatgtcttatcattagagagatgtgggattaggtaaggggcagagtcatggcactgctcacacaccttcccgaaactggggtctattcagttttttgacaagatcaaaagcaattcttaactggtcattatttttttttaaggtaattagaacactattgtttatacaatattgaaaaaatacaattttttattgtttgaactcaaatcaccacccagcactttaagcctaccctaaatagcacctacaataaatgtcatagcacaagcaaactgcaaagtcagcaggtaagcaagttagacagtgccagcagagagaccctccctcccccaaagcaatgagaagacagcgtgctaggtaagagtgaagtacaccattacatgttaaatagttaatactacccttccagcaagccacagatgctagatggataactcagtacggttaactaaccacagccctacatcactgcacttttttttttttttaaagaaaaccttttgcttcatgcccgtaattaacataaagtaagtaaattctttgtctttttatttaggaaaataatcatgctaaaagcaagttgtactttatatagattttcaaacaaaagattgattgtgctttttgaataaaaaagatagggtatcttccaacctcactgacttaaaccttgtggaatacagcacttctaaactaaaaacacacgtcaaaaagaaaaattaaataatcccagtgggatgctcaaaaatcgtctttagaaggttttaggattggctaattctgctattatcttattggctgcggcaaaaaaagaacacagagctgctgtctaaaatttctccaaactcccctccgagttcagcaggcaacactcagatttgaaagaaactctgcagcaacctggacatatggttagctgagtcgacatttgattagcaggcattttaaactgatttcctcttaacatacgcaggagagaaaacattttcttcctgcagggcatgttctactacatcatatttctgaatcccttcttcctattcggtcactctctgaaaaaagctggtttgtttttcccatgtagaatcactctgggtacaagaacctttatttgttccaattattatttgttttaaatttagaacctgtgttgggtctaaaatacccatttcccactcccacaagcagatgatgaccaggctgctgccaagagcagcagaaaaagggaaaaccaaaccagaacatgaaggcaagtacccagggctttgcagtcaccacgtgggtcgtcttctcaagtctaatggtccatgagcggcttgtccaaggaggcggccgcctcttggtaggtgaagatgaaatctgcaacctttctaagcacaatacacacacacacacaccaaaaaaataacccccccagaaacacaaccctcatatttaaagctcttaagttcagggtagcggtctcaaactgccaaacactaggatgaggatgtgactctgcatgtgttttggatgagaggaagcatcgtcccagtcacttttctcctcctgtgctgtcctttcaaaaacaggtctggatttcacgctctaccccaagaaaaagaactggttcagaaaacacttccccaagtttctccaacagaacactgtggctgcagggcctggtagtgtgaagggcagcaactgacatataaaaatgtacttaaaatcagagtcaaaaaatggttttaagttttaatactcttaattagctccctgctttatactgtaactccacagaagacatagggccacctaggattcacaggaaggagcagctctgattcttacatggctggctccgatgcccccacagcaggcctcttcctccccaagtttttcctctccatttcaaaaaagcactattttatcttcacatccaagagctggttggtttggtttgtttctttggaaaccaataaaagaagcaattttttcctgttctttttactcacatctacctatcagagcggctatttccttcgacagttcagtagcacacaggctgacttggccacatggactcatgaatgcatgcattcagaccgcatattgctaccaaatggaatgtgggaatatgctatgcacctcaggttgagaaatgaccaagaaatcaagatctaaagggtgatatataatatatatatatcaatgctattattcataaaaaccttgtttagtaataaaaaaaattgctttgtttaaatatgaatattatagtctgcttctcatggttaggaaataatagtctttctgaaaagcaggtgctttttctactacaactccatatcctgggcctcatcttcggaaaagtcagacatagagctctccgatgagctgtccccggtaccctcttcctgttctttcagcgcctcctccgtggcgtatttctggatgtactctgcacggggtgggagaaagacaacaagggcagtgagtgggcaggcatgtgctttggcgaccccaaaaagctggcaaggctgcggaggttcaaacttaccttgaacaccaggggggacaaagatgacagtaatcatgatcactacagctaaggagaatcccatagggagacttctttgggacagggtttctgcattttgccccctgaggaaaggggtattgggaagagcaacacagcaggctcagcttgcaggggaatgtgtgtgctgcagcaccccaagaactcttcagggaccagggaaatgggagccccacgctttctttttactttcatctcccagatagtataggaccagtcatgattccatagtaatttataaggaaatccttcatcatttttagatctgcagttacataattacggtcagtccaggtctattattttaggaatcgattttagtctaaacagatcctgcctgtcaggtttttgaagcagctggcaaaaaccatcgctcaatctgctcaggactaagctgctatacggagacaccactcggctctgagtggtttttccatgtataatttacctgaaggtagatttccgctgctacagccttggtggaaccctaggctgaataagactgctgaaacggcttttaagaactgctgaataaacaaacttgttcctaaaaactctaagtgcatactgttttcaagtgaacagcctccacacaataggaaaagacatgacagaaacctattcaaaatgcaagccacacaaaaacacacccttgtggctttgtttttcctcctatagagttgcggggactcactgcaataggaagataagctgaatggccaaatgggcctaccagatttgaataactagcacagggcctagctaagaatgtttttatattttaaaaactgtcttaaaaaataataaacagaatgtgtgataaaggccacatctggccaatgtggtcctttacagaaaaggtttgcagacttgagacttagagcccttcaaattcattataacaaaattttatgctaatgattttgatgagattaaagtagcccatgattaggtaggaatttaccttaattgagaaatatttattcaaactttaacaattttatttttaacctctaatgggttgactattttgcgtcttcctttgtagaagataaatattgacctttttttgacactagaatttgatactatcagccctctttaatgtattcaaggaaacaaatgtatattaagtacttactaggacaaggcctttgagagagagaaaggaagagcaaggtcaccaatgaggaggaggaaacagaggaagataaaaggagctgctgagtgtcaccagagggaagcagttacggacgaaaaacggccgaggcagtcccagccacactgacccccaagtcctgccagctatggcataggagaggccactccagggaaaggctttgttttgttgaaagtaagtggctgggatgtttaaacacaaccttaagagagaactatggccaggtgcagcggctcatgcctgtaaacccagcactttgggaggccaaggcgggtatatcacctgaggttaggacttcgagaccagcctggccaacatggtgaaaccccatctctacaaaaatacaaaaaactagctggatgtggtggcacatgcctgtaatcccagctactcgggaggctgaggaaggagaatcacttgaacccgggaggcagaggctgcagtgggccgagatcgcaccactgcactccagcctaggcgacagggcaagactccgtctcaaaaaaaaaaaaaaaaaaaaaaaaaaaaaaaaggagtaagggcaaagatgtagattccactcagtatcagagagccctgaatggcaggcaaagatgtcacccagcaaagggttttgagcagggaagtgacagctttagacagctccaatggtgcccagtgctacgggctatccaatatttaaacactttttcaaacatgtactataatacagcgccaactaaatatgaacactgactgtgttagctgtgttgggttggtggtgactgccacacaaatggaaatgtccagcagcagcttgggagagaggccaggcctagacacacattcagaaatcatctccctggaggggactgactgaagctgtgagaggtgaaacagctcctcagggatgacaaaggaagagagggagcccagggaccgagtcctaagtgaatgaccacatttaggaaatggaatgagaagtttccagaaagatgagggtaaaatgtaacacttgcagaaaggtccagcaaaatgggacttgagaagagtccaaaggattgggaagaaatgagggcacagattaagcagaggaggggaaaaaaactagaggagtttaaggtgaggacgcaagaagtttgaaaatgaaaaggaataaacagcatgactcctaagagagcccacaggagcagatcactgctcctgaaacagggagacctctgatggggtggaggaggaagactgcattgggagggggcggggggttgggggaacaagatcacagattggtggtgggagtgagtttgagaaatgaggaagggtgtctcttatttatttcctatagttaggaacaaagaaaagatgcaggagggaagggagaagatatcaaggcacagtaggaagtgggggtgagctcaggtctgatggccatgattttctgagattactaaggaagacaaaatgatagccaacatgaacatttccgaaggctaggggtccgtacgctggagtgagccattctaagataaatgtaggctcggttctttttgtaaatgggactatagcagacatgtactgaaacagggctactgctaaattgttgagacagaatgcatatgtgaactagagaaatatactctgctccaagatatctgtggtttgcagacattgctaagtgattcctatgtcaaaattttaatatagtctcataacagcactttatctggctgaaactgactgcctttttcttcaaatacatgtttgcttagctatatattttgctacataaattagatattaatttgcaaagcacttgagatctaattaattatagtaaatttatttctgctttatctcaacaacagctccaaacaataccctatagagaccttggaagaagaattagaaaacaaatagaagaaaagctattgtttcatgaatagtccctgtttgcctcatacctgcacatttcagagtgaagacctgcacattcaagctctggtaaattacttctactgccacctcttgcaaatgtacctcagagaggccacacattttgaggaagcaaacattctggactgctatgcagataggcccatcatgtgaaaaactggctagatactaatgcctgccattggttaaaagcagcaggtatatttcacaaactttgaattcctttgcttcttggtggagcttcatgtatctagacttttcactatgaaagttctgaaacatacacagaggtaaaatggaaaatccaatgaacccaggtggagctttagattttttttcttttttaaagacagaatcttgctctgtcacccaggctggagtacaatggcacagtctaggctcactgcaacctctgcttcctggttcaggcgattctcttgcctcagcctcccgagtagctgggactacaggcgcgtgccaccacaccaggctaatttttgtatttttagtagagatggggtttcaccatgttggccaggctggtctcgatctcctgaccttgtgatccgcctgcctcgggctaccaaagtgctgggattacaggcgtgagccaccacggccagtcgcaaacttatcttcatttaaatgaaactcatatcccatcagcacgtaaactgttttaaggatgggaaaataggattctaaatcgcaaaggatgagcaaactggtgctactgccacccgaggttggtgagcactacttcagcccacagctgtctctttttaggcctaagaaaaagtattaggaactaagtaatttaagaaggacttttaatgactgaagcccaacagatttaagttcttttgtctccaggttaaactacccatcctcttacctttaattttctgcttgtattcttctggtcggtggaggtacatggctgcagcgtcaccattgagaggatctatggggttaggataggccaataactgaggcaggaaggactcaaatatattggtaagatctgaaaaaccaaacaaacatgtcacacatgggaaatgcaagttcacctaaaattcacttgcattcagtagtcaagctgcttaccttcttagatattcacacggggatgattctccatacgagtgtgctctattacatgtgacttgtattacacattcatttcaataccaatttaaacattttaattttaatttgaagaacgagataaagatatacctgacattcactttgaaggacaattttcccaattctatttcactctatttatatggctatttcacacagccattttctacagcttacaaaaccccccactctgaaaggtattcagatgctgggtcttaaaagaattgaagacagtttttgtggggtttttttgtttgtttttttttttgagacagagtcttgctctattgcccaggctggagtgcagtggtgcaatcctgactcactgaaacctctgcctccatgttcaagcgattctcctgcctcagcctcccaagtagctggcactacaggcacctgccaccatgcctggctaatttttgtatttttagtagagacggggtttcaccatgttggtcaggatggtctcaaactcctaacctcaagtgacctgccagccttggccttccaaagtgctgggattacaggtgtgaaccactgcgctcagccttgaacacaattttataggacttgacatttaattcaattcttgcaacttctaatggaggtaaatataaccaatttttcaattattctgggtaatgaggataggaatctatatggaccacataagactacaaatattcataagacagataagcaccaatctactgcatttatttatttaaaaaagttttttttttgagagaggatctcactctgttgcccaagttggagtgcataggtgtgatcatacctcactgcaacttcaaactcttgggctcaagccaacctcccagcctcagtcttccaagtaaattggactataggcatgtgccaccatacccagctaatttttttttttttaaatagagacagggtctccttatgctgcccaggctggtcttgaactcctggactcaagagatccttccatcttggcctccccaagtgctgggattatagacgtgacatttattaactcctttcttgccaggcatacacagatgatatctacacacagttagcaaacaacaaacacctgcagttacccagcgttttagaaaagcaggccctgagaacctgggtataacacaacccacacaccccatagctcagatatgctgtaacttccacactctgctcctcagtgaactgcagcacccctgagaaatggaaggacatgagaatgcttccatgtctctgccccactccagctgctttgtcatgttttatataaaacattcctgtttctggagacaatgctgaagtatactaagtagcataaaaaactactcattaatttagtcagctctttcaaccaattttgcttttaacaatgggcgctcctttgcagtattacagatgaatgctttgccaagccacattgcttgagatttgtggttctcagccaagggtgattttgctccccatggaatttggcaatgtctagagacatttttggttgtcatatctaagcggtgctactggcatccggtgggtgaaggccagggaagctgctaaacaccacaatgcacaggacagccccacaacaaaggattatctagaccaaaatgtcagcagtgctgaggttaagaaaccctgatctagataaaagcggtaggcaaacctttttgtaaagggtcaaatacttttaggctttgcaggccacatatggtctctgtcataactactcaaaactcagctctgccactgtaacacaaaagcagccaaagtataggtcaacaaatcgatgtggctgtattcctataaaactacatatacaaaaacaagtacccaaggtctgcccaactttgctctagaaaatcttacctataagaggtggctcttatcactgtaaggttaagaagctgagcagttagagactaatctagagctgtgttactcaaccgaactttctgcagtgataaaaatgttttatatgtgctcacctaaaccaatagccactagccataagtggctactgagcactcaaaatatggccagtgtgaataaggaaattaattttcagtttatttaattctaattaaatttaaataaccacacatggctagtagatcctgtattggacagtgcaggtctagagaatgatgggctagagggtcccatgacagctaccacgtcctgttctcacacaccaggtattgacacagagcagctctgccttacaacaaaagccacagacttggggtgatttcatcagagtctatttcaccttcataaggctgacttcagaacggtcctaaagagccactttatagtaaggttctcatgtaccacgaaagaaatcctgacactcctaatcaaaaaagcaaaacaaaaatcaccttcctatataacccccaaactatctgcagtaagattttcaccaatgttttatctacaatttttttaaaaagggaaacaattattatggtacaaaaccattgaaaactatttgttttcaatgaaaaaaatgcttatacttgaatgctgggtagagaaaggccataaaatggtatgttttctagaattacaactatgtacagtgtgtatgcataagacaaacattttaaaaagctacctcaaggcaatagatgtgtaacttctacttttcacatttcaaatgacatttcttttgcctttaaaaatcaacatttttggctcacacctgtaatcccagcactttggtaggccaaggtgggtggatcacataaggccaggagttcgagaccagcctggccaacatggcaaaaccctgtccctactaaaaaatacaaaaaattagctgggtgtgatggcgcgtgcctgtagtcccagctacttgggaggctgaggcagaattgcttgaacctggggaggtggaggttgcagtgagccaagattgcaccacagtactccagcctgggcaagtgagtggaaccctgtctcaaataaataaataaaataaaaataacattttcctgtaaatatgtcctttctattttggcatatgtttgaaatatccaataaaacatgaaaagtctgaaaatgtttttattttcttatctttatccttgggtgggtgagttattaaggcagtggtagaaaatgccaaaaggtaagcaaattcagttttacaggccagacgcagtggcttacaactgtaatcccaacactttgggaggctgagatgggcagatcacctgaggtcaggagtttgagaccagcttggccaacacggtgaaatcccgtttctactaaaaatacaaaaattagctgggtgtggtggcaggtgcctgtaatcccagctacttgggaggctgaggcaggagaattgcttgaacccaggaggtggagtttgcagtgagcccagactgcgccattgcaccgcagcctgtgcaacaagagcaaaactctatctcaaaaaaacaaaaataaaaacaaaaaacagtagttttacaattgaatgtgatcccatagcagggaaaagttaaacaatagttacattaacagtaatttttttttttttttttttttgagacagagtcttgctgtcaaccaggctggggtgcagtagtgtgatctccactcactgcaagctccgcctcctgggttcacgccattctcctgcctcagtctccccagcagctaggactacaggcacacgccgccacatccagctaatttttttgtatttttagcagagaaggggtttcaccgtgttagccaggatggtctcgatctcctgacctcgtgatctgcccgcctcggcctcccaaagtgctggaattacaggagtgagccactgcgcccggcccattaacagtaatattaacagtaatggcaggttaatgcttacatagtgcttactacaagcaaggaactcttccatggtctgcatatacactcttaatttcactacagtcaatgaggtaggcaccattttacagatggagaaattgaggcacacagagcttaagtatggatcaggaactcaaacctgagctcatccactatgctgcctctgttaatggataaaacacacactgccgctgccgcaaatttcacgaaggcacaagctccccatgtctctgggtcaaaatcgcataccatcgctggcagggaagctaaatccatggatcagagatgatcaccctcctccccaaagaatccctcacaagtgcaaagaagcatgctaagcaaaggacgttcagatgtttctgtggctattcacagagacggtgtgcttgttttcatgcagctccaccgcaggaggtaacccgcagacacctgcacacagcgaacggaaggctcctcctgccatattattattacaggtgctgctcaaaaggattagcagctggatgctattacataacaacgaaaacctttaaaaacaaagcataggttttatgttctgaagtaatgttcagaagtgcttcagggctagagaaatatcacagacaacgtgttataaaactaggagtttagcgtgtcccagaaagagattttataccctttcctactacttttaagtttcctcaagctaccaataaaaggctttgcctatgaatttgttccaaacaaataaaagaacccttaattattggttcttccttcctgtatctaccgtcttcctgcattaacacatttttgatccattttacagaagtgctgagtcacacctgtaaaacagaagagcagaaaaggaaacacatgaggcccagttttgggtgaagatgacaacttcgggaggccaggatgtgatggctctgccatcttaaagcaataaggccttcctgcaagtggctaacacagtgattactcctaagggtgcttctgaaaggagcatctctcaaatgtgcagatgtgcagaaagtcttctttcaagataaatacactggcagagaagactaaaactataaatcaagaataaaataaagatactcatctgtagaaaaataaagaacactttttccctagatttttgttaatgataaaacgataaaaatgtgtcgataataataacgataaaaatgtgtcagttcaaagatctttatctaaaaacattaaccttcaatttttttaaaggaagagagccagatacagttgacctaaacctgtagagtacagtcagccgaccccatttccgcctgtcttaacttttaaaggaagtcccaagattcctgagtatatggtttatgatgagcaaacagctcttacttttgccttagactcaattagaaccaaaatgtggttcattagcactgactcttcagtctgatcttacattaatgttaaaattataacactcatatctcagtttaggcatataatttatattcatatttactatttaaaaacaggctgggcacagtggctcatgcctgtaatcctagcactttgggaggccgaggcaggtggactgcctgaggtcaggagtttcacaccagcctggccaacgtggcaaaaccctgtctctactaaaaatacaaaaaattagccaggcgtggtggtgggcacctgtaatcccagctacttgggaggctgaggcaggagaattgcttgaacctgggaggcagaggttgtagtgagctgagattgtaccactgcactccagcctgggcaatggagtgagactcccaaatcataaacaacttatcatcaaaagtagcatcacttagtctagagcagtggttctgggctaagtctaggtcctgcttgtccatcacaattacctgtggagtttttccaaaaacttgcttagcatcctaaggttgcagcttcatacctaccccagggcttctggtttaggactggatgggatctgtatgtgtgtgatacagacatctgtgtgcaaaatgcacaggaaatactacctggcccatgatcccctatccccaaagaatagacgggaaggaaagggccatttgctcgtaggttcttttttgcaagaaaatgttcacctctaacagctcgactctggtttagtgacattccctgacccttcccactttcttttctgcacactgctgttaccactgttatctctaggcagaggtgtgccaaaccacaggcagtcaaaagcagatctgttctggaggggaactaaagggccactttggaggagaatgggtattagaggatggttagaatcatcacctaacacaatgtggacatctggcagagaaaattccattaggctgaactgtctccagcaaacagaaagctggctcctcagtggtgaacaacagatgaaaaatctaaaagaccacaagtctaatctcaggctttccactgccttgctctttgaccttgggcaggtctcttcctttctacatctcaatttcttcactgcaaaaggagaagtataacattgctattccttacagggaagtaacacacattactaaaagtgactataagatatacttcaaattgcaccagagaactaaactattaatacaaatatgacatcctcaaagggtagacatttcagctacctgtatcccttaaagaatatgtattaattaaaaagagttacactgaaaaaaatgtaccaattcttaaagtaaaattgccctattccaggtgactcacaatgaaatggtgcagggcttgaaggagaaaacacaagaggggatgaatcacacatctcatgttttattcttggctatttatgaaccagtgaccacaagttatttctttttcctctatttcctttgaaataaatggaaaatttcaagctgggcaaggtggttcatgtctgtaatcctagcactttgggaggccaaggcaggaagacggcctgagcccaggagttcaataacagcctgggcaacatagggagatccggtctctacaaaataataataataataataataataataataataataataattgggcatggtggcatgtgcctgtggttccaactactcaggagagtaggtgctcagtagttgccgaggtgagaggattgctcaagtcaggggcaggtggatgggtcgaggctgcagtatgttgtgatgccactgcataccagcctgggtgacaaagcaagaccctctctctaccaccccccactcaaaaaaaaaatgtaatatacactgctttctgcaggttaaaatcctgtggatacccaaaccttgacatgctctgcctcactgggaaccacaattagcacacaggcagtcattttggagacttttacctaaatattcttcatttgtttttcggacttaatactgaaaaatacatgctgtaactcagaaaccaccaccaagtggtgccaagtgccaagaaccatcaaagccattcttccgttctcaatcccacttaccccatcccctttctccttctactacctgtcccccagaagcccaacatcctgttaaaaacaaataacaaaaaacttatcgggaaagacatcagcatcctgcacagcggctcaaattctgtggcatttgcattttaagaattagctttgtacactgttaccccgggaagccgtcatcctataattattattattattattattattattttttgagacggagtctcgctctatctccccaggctggagtctcgctctatctccccaggctggagtgtagtggcacaatctcagctcactggaacctctgccttttgggttcaagcaattctcctgcttcaagctctagagtagctggattacaggtgcacgcccagctaattttttgtatttttagtagagacagcgttttgccatgttggccaggctggtctcgaactcctgatctcagggtgatccatccacctcagactcccaaagtgctgggattacaggcatgagccaccgcgcctggccatcctacaattttaaaggaataagtctactgggtgtggtggcttgtacctgtaatcccagttactcaggaggctaaggagggaggatcactagagcccaggagtttgaagttacagtgagctatgatcacaactactacactccagcctggatgacacagtgagacccagtctctctttttttttttccagagacaagttctatgttgcccaagctagtcccaaactccaaggctcaagtgatcctcttcgccttggcctcccagtgctgggattacaggcgtgagctaccatgcccagctgaggcccagtctctttaaataaaaaagaaagaaagaaaaataagaagtctatgttggtaactaccaaatccatataactggtccttcatatgtctagtcttgtagtcttatcaaactttacatgtctaagattattttcctgaaaacccattcccttcacctaatgaagggagtaggttgactctaacgccctggctctcaggctccaagcctctggaaggaatctggctaggtgttcttcctttcttccatgtactcactcagtttcccagaaatgtctctagtttttcttttatttcccctggcatgtaactatgtcaaaaccaatatatcattccagccctggatcagggcagccatctactaaatggccttaaaggctctatactctcgcctttgtaatcagagaaagtttccttaaaacaatcacttaggtcatttcccacaaacaataagttcctcttgccctcaatcaaaattctgcaacctggagaactgcttgaactcgggaggtggaggctgcggtaagccaagatcacgctgctgcactccagcctggacgacagagcaagactctgtctcaaacaaaaacaaaaaacaaaaaacacatcactatgtaccccatgaatatgtacaatgattatttgccaatcaaaattctgcatcctccagaagcatgctatccaaacttctttcatcatccctctccctctggaggaggactcctggctttccaagccgaaaatcacagggatagtcactactgtctaaggtatttatctgttctgtaattcaataaggaacagggctgacaggaaaggaaagaaaaatcctgttcacacctagaggaaaacatggacaaaaatcacaagtcaattgttgtctagaactgatgattccctctgtgacttacatagatctctttcccctgaacttttggtcattatagttgaaactcctgggaatttcacccaagttattcacatccttgactactagagaaaagcagctgttgacctttcaaaattccattggttgactttaggaactgtattgaattcgtcatgaactgccacgcaagtcatgaattttacaatatgtgcccaaaataaagccaaccatgaaatctcattcattccacaattatttttggtggtggtggtgggtatctactatatgcacaaaaaccaggtagcttttttttttttttttggtaaggcctgaaatagggcaaataaattaagatctccagatttctttaggtacttaataatttggagttaacagattttcctcaagggtgtattagacactataattaatagatctttaccttctactcctttaccagctcctacaaagcagcaatattaataatggttgaatttttaattttatcctgcttgcagtctgtaaacattaaaagacagtgaaattctacaagaaaagaagagtagtcaaaaacctataaagagtcctacactgcacacaactaagcagttgttatttttgaaaaaaacttgcaaacagagggccctaaaagatgacagacagcccctcaaggaaaacttcagtaaaaccaatcggataggcaggcagaattcaaagaaacagttttgagattaaaagtaatattctctaaaataactaatttgagccgggcgcagtggctcacgcctgtaatcccagcactttgggaggctgaggcgggcagatcacttgaagtcaggggttcaagaccaacctggccaacatggtgaaatcctgtctctactaaatatacaaaaattagtcgggtttggtggtgggcgccggtaatcccagctacttgggaggctgaggcaggagaatcgcttgaacccaggaggcagaggttgcagtgagccaagattgcaccactgcactccagcctgagtgacagagcaagactccatctcaaataaaataaaataaaataataaaacaattaatttgaactcaacttcagtgacaaaaagcccatttctccacctgttttgagggcacacaggtggagagctgaagcaacccaccagacttcctgcagtgctgtggctcaggcccaactggccacagggctcacaatgctgcacctagtttactgaaggctaactagctgcaattaagataatataacccgccaccaaatactaaaaggtatattaaagaattcatacaattacttgactgagagggtctcatgtgtggagaaaatatataaaaagtctaagctcagcagattcacatatcttctcatattagcccatggggatctttaaaagataaagtcttaatgaagagggccatgcaggcaacaaaacaaaacaaaataaaaaaacagaaacaggtgaaaacacctccgaaaagaagtgggatgcttaaaaaacacaccaaactcttccctcctcccacctctcaaaaaaggtggctgggtgcagtggcccatgactgtaatcctagcactttgggaggcccaggtgggcagatcacttgagcccaggggttcgagaccagcctggacaacatagtgacacccccatctctagtataaataaaaaattagcctgatgtggtggtgcatgcctgtagtctctgctatttgagaggctgagacaggaggatcacttgagcccagaaggttgaggctgcagtgagccacgctgcactccagcctgggtgacagggcaagaccttgtctcaaaaaaaaagaaaaaaataacaattagtaggaattcaaacactcaaagaatgtttgcaacatacatgataaatacatttaaatctcagtagtagcattttggtttttaagtattcaaagctagaaacaggtgttcctgtgctgtgtgggaaagggcaatatgaaagatgcagggcgctggcctggcgtggtggcacacgcctgtaatcccagtactttgggaggccgaggcaggtggatcatgaggtcaggagttcaagaccagcatggccaagatggtgaaatgctatctctactaaaaccacaaaattagccaggtgcggtggcaggcgcctgtaatcccagctacttgggaggctgaggcaggagaactgcttgaacccaggtggcagaggttacagtgagccgagattgcgccactgcactccagcctgggcgacagagtaagactctgtctcaaaaaagaaagagagagagagagaaagagagagagagggaagggggatggggggagggacagagagagagaaaggagagagagagaaagaaagaaagaagagaaaagagaagagaaaagatagatggacagatggatgcagggtgctgaaactgggaaaaccagccacattctgctcagggccaggctaccaggccaccaaactgaggtgtgtagttacaggacatagactgtttttaaagcattccaaacccgcttaaaaggtaatttcccattcattgcctaattgtagcccctttccccccaacatatttaaacttcagagagttgcagaagaaaataagtgctactgcatagatcacaatgaagaaaacaagctcttgttcatcaaaaacactgctcttgttgcattgtcaatctcaaaacaattctcgtctatttgggtgttttttagaggtaattcatcctcgttcaaaccttataaccctgcttaccttaagagcttgtaagctaaaacatggtaataggatttgttattaaccttccagaaatgagggcagttaatgtgtaattagctagctggatagtcttgctgtcatactaaaactcgctattcaagcttgtaattactagacaataatttagttgttaatatcagaaaagaataacaagaggtaacttcctgcaattacaagccaagtgtccatacgctgggaagactttataactcagtaatcgtaagtgaatgaagataaaacaaatcaaggttacatttacatataatcaagaatgaaacaagccctaaaatcagagcccctacgaaagtagagcatagctgtggctgtctttcagagccataccctggctggctcatgtcccacgatccaaaaagcctggaccaccccatggttttaaagctgaccaccagtgagtgtggtatttttaatgaatgtccactaagttgttcaaagccagcaagactccatttttatgtatataactagttagactcctgagccacatacacctcatctgaagatttccaagcagacagataaagaaggttggttacggagctagctaagcactgttgaagcgcaaatccacaactgagcacatttctttattatgtacaacaggtgacattatcccaatagtactggacagaattgctctacttggcctctatctacaaataatgacatccagctgttccaaaggcaggatgacgtttgtgattcaacatggacagatcaatactgaagttctcaagctgttcaaatagtagttggccaattaatcatccatgaagacacatacatgtatttcttatctgtgtagttacactaaaatgtttaggaaacagcatgcactaatccagcataaagcattattttaagatataccttctgccaaaatctgaattatttgggaagattcacagactatctaactgaaaaggggatgggataagtgttaaatttgtattttaaatttctaaatgcctggtaaaataaattttaggtgcctgtagtcccagctactcgggaggctgaggcaggagaatggcgtgaacccgggaggcggagctcgcagtgaactgagatcgtgccactgcactccagcctgggcgacagagcgagactccgtctcaaaaaaaaaaaaaaatttgtatctcttgcctaatctcaaagtccttgaagtattccttctgttgtagtcaattttatttgcctgttactaactccccagataactctaggggaagacttttcccaaatgttgatttttctctccagcaaaataagagtagaagtatctagtccactggctagcaaccctaagagtgaaaatgtaaactgcccaatttcataagaaaattgtcttccacctcacttctccacaacttttttttttgtttgtttttttgagatggagttttgctcttattgcccaggctggagtgcaatggtgcaatctgggctcactgcaacctccgcctcccgggttcaagcaattctcctgcctcagctgtccgagtagctggaattacaggtatgcgccaccacgcctggctaattttgtatttttaataaagatggggtttctccatgttggttatggctggtctcgaactcccgacctaaggtgatccgcctgccttgtcctcccaaagtgctgggattacaggcatgagccaccgtgcccagcctacaacttaatccatcatataaataatttacgaaggcagtcaaagaatgagtaaaatgaaagctggagagagaaacacatttgcagggatcaagcatgcctggtccagaagggtgggatgagagagagattaaagctgtatcgcagtgaaggcacctgggcccccaggagtgcagggtgataagccaactacagataaaatatattttggagaaaaaaaggaaaactggaaaatagaagagtgcttaaaaagctacctgtggcttaatgaactctcctatcagtccttaaaattaatttgttttgaaatggaaatccagatccccttggctacattttatgtttctcagagcttctgtcactgctgtctggaagagcaggaagggatgcaaaaaaaaagatgctatcatgcaggaagccaaaatcactttggtcatctgctactttctgtttaatgtcataacaataacaatagataacttcatacttgataacttcatactgatggcaagcatcttacaaaattaatccgattcctcactataattagctctcttgtaaggttaaataatacaaaattaaaaattactgggtgagtaaaccacaattataccaattttgaactctgaataaacaaattgcacatacacttggcaaagagaaaacaggataagaacagaagcaatgagtcaactggcttaccagaaatcaatggcggggaagggtgtgaggggacagaggactaaatttactgctaacatgaatgttgtttaatatcaggctatgattaacatacatctgaaatttcaactgtgaattgttgttacgctacaaatatgtatacccacagaacagtacatgtcctggggcaaggtaaatggcaggaaatttcacaatccactccctgctccctcatcgaatctacagcagaggaaagtgttgaaacaagttttaggtgccaggcttagccttttgcttttcagttgaatatttatgttgacacgccaactttctcctattagttatttagtgttagttttttttttttttttttttttggcggggcaggggttggcgggggcagtcctttgaactaagattctctcaggaaccactgcaggaaatgaagtgattcagaactcaccaattatgaactaaccttcaatgccagaggctttaacagtttctaataaaaattcagttcagatctcaagttcagataagtctgaaaaaacacttcaaggtcatctgaacgaacatattctaccagtactttatataattgtatttacctgttcctaaaactttccgtgaaagaaatgttgaattttcttcagaaatagttttgagcaaaatgtcaaaacaattctcccatgctcagtgtacttttgactatactctgaaaatatttcttcttgttttcctgcacttacctgttagtgtgctcacactcctgtattatggaacatgttcagtaactcatacacatgtaacacagaagtctgctttcagttcacttggaccaacgtggtttaactcttgctgcttattaaatgctttgcaagctaatgtaagtacactaacattttataaatgtgatgaaaacttactcatgttggccactttacaaagtagtctatcagtcctcaaatagttaaacatattatccagcaatttcactcctaggtatatacccaagagaaatgcaaacatgtctacacaaatacttgtgcacaaatatttataacactcataatagccaaaagacagcaataacccaaatgtctattatctgacaaataatgtggtttatctacacaatgaaatattattcagccataagaacttccgatacatgcaacacggatcaaccttgaaaacattatgcaaagtgaaaaaaaaaacagtcacaaaagaccacatattatataattacgtttctaagaagtgtccagaaaagacaaatccacagaaacaaaaagcagattcgtggttgcctagggcgaatagttaaagggtacacatttatttttgaggtgatgaaaatgttctaaaattgactgtggtgatggctgcatataactgaatgtattaaaaactactgaattacacactttaaatgggtgatttgcatgtctgtgaattataattcagtgaaactgttatttttttaaaaaacctgttctgagacatgaagtacttgacagtcagcaaacatctttcacaaagcttttctggtcaatggtaaaagctttagcaaaactaaacatcaatttacttcattgtaattggaaccagattgcagtattttgatatgtacatttttaagatgtgaatgtagtttaagaaaacacatcattacatcagatattccaggcagcctgccatgagacatttttaccaaaaaaaccatcttaaaaggaatccatttaatcaagctcggagtgtatgttctttcttgttgcctcaactatatgccatcatctcccctaaaactctcttgttaaacagttctggacatgattaattcactcattaagacaacaaatagtcgaacccttattgtgcaccaggcactgttacagtcacgtgtgcgtgtgcgtgtgtatagagagagagagacgagaacaagacaaagtcctcactcatggtgcttacaatccaaggggataagataaataatatacaaataccagttttagaagcttattgaaaacggggtactagccaggcatggtagtatgcacctatagtcccagctactggggaggctgagatgggaggactgttcgagcctaggagctcaaggctgcagtgagctattatcgcaccactgcattccagcctgggcaacagagtgcaactctgtttctatgtattaaaaaataattttaaaattaaaaaatatatatacaactgggtgctgtgctatggaggggtgtgatttcagatggagtagctgggaaaggaaactgctctgaggaagtaatatgtgagatgagtgaagaaggtgctaaccacacaaagatcaggggggaatatcccaggtagagaaaataatttttgaacggcacaatcaggtggaggcagggattaactgtgttctgctggtgaccaacctttctctgtgattctcatttaccaatctagttcaaggatatctggcaaaagtaacttgcagattgtggctggactaagaagtcttacctacctcagaccactaaaaggtcgtacaagttcaacaagaagcagccatccctggttaagctcagcctcaactgagctttcccttcttttcttgtgcctctcagcaatggttacctgtaccattcattctttcaacccatactggtgaagggcactgtgataagagtcctgggccttacagatgaatcagacacacacccgatagcccttaagataggaaataatctagtagcacaaaaaaataggcataaacaacaaatacacagtagaaagtaaaagtggaccataaaaaaggagctataaaatgtaatggtatccagagattacttccagctggagaatcagcggaagtatacggggtaggagcactggagtaggtagactctatgaagcctgagatttggacatgtggagggaaaaacagatttatttgttgtatccctaattaacttcaaatacacaactgacccttgaacaacatgggtccacacacagtttgaactgcatgggtccattcacatgtggttttcaataaatacagctagccctccatgtcagtgggtttcacagggatgactgtgggacttgagtaagcatgaattttggtatctgcaggtggtctgggaactgatcccctgcagataccaagagatgactgtattttaacatattttcagctccccaaccaggtgataaggaggaaaggcctgatgctctttataactctctgggatattcagcatagcattttgcagagctgggcaattcatttgttgattccctgtaagagatggggtgtcaatttcagcactgaaggtaaggctaaattactcttccttcataaggaggttttggtctttgaaaagatgatcccctaaaacctcttactatatcattgctctctcatttcagagggacattcctaagtagttttagttttttccaaaaccaaaatatgtatatattatgtgctaatacatacatataaaatgtttgcacatgtattcatgtgtgtgcgcatgtactcatgtgtgtgcacatgtatcactataccttaagtttggaatctcaaaaaatcattttaaacttccacagctaaactgatatatttgtacttaagagaaaacattttttccactgatcaaactttcccagtcggtccctcaaaaatcccttcccattaccaacaaaacatcttaaaccagaaaagaaaagccaaacaacatttttttaggcaatgtctcaacatctccaaaaaatattccatggccaaactcaccatagagagctgtccaagtttgattaattacatctagacacacagttcctgacctgaaacagatggaaagaatggcatgtttttaaaaattagaaagttagttgcatgtatctggcaactaatttttacttatcaagagaaatacttctaatagatctgtgaaaaaaagaatcccaattggggaaaagtatgatgaggaacagaatagtaccaggtcttgaagtgtcaccttacagactgaaaggggaaaatagtaactatgcaatggagaaaccagacaacacctgaaccaggtgctgagaacacaaggggcagacagaccttgtgtgtctctgaatgtgataccccaagaaggacaccatcttactttgtagttttctggccttaagtgtgttcatgccctgaatctaatgatcaggaaacatcagacaaacacaaattgaggaacaatctataaaataactggtctatgttattttaaaaagtgaattttataaaagataaaggcaggctgaggaactaatcctgattaaagcagtttaaagaaacatgacaactaaatgtaatgtgtgattctagactggatcctttattgaaagaaaaaagtgctaaaaagtaagttactggaatatggcagtagattaaataagtattgcattaacgttaaattcctgaatctgacaactatatactgtggatagataagagaatatccttgttaggataactgatacaataaaatattaatattaaaggactaaggggcatgatgtatgtatatatacaacctactcacacagagtgcagaaaaacctgttaggtatgtttgtgagagacagtaaaacttagtgccatgacaaattaaaattgcatcccaaacaataatatattctaaacagcactagaagtataaaacaggatatgctggaatattttaaagtatcattaataaaatattagaaggaaagaaggggataaataagattcattaactgaaatgaaactatagtcattttgccttactatctatcaagaattgagaaaatattataagatctgaaaatagtctatctgtaggctgaaaacagatctctgaactgtgtctacaaaaagagaagtgagatgtggaatattactactgtttgctgggtaacaagaaaaatgaaggacccagtcacgacaatggaaaaaaataagtggtacaacagcagaatgtgaactaagtgattgagaacctcatatcctttggattctatcatttacatgaccattcatacagtcctacctcctgataaggtccaaaaagataaccgaggctttttataacacagagaaacactaatcatgagcagttgctgctaaaattgaaacattttaaaatagttacttacgcttcatcaatgttgggatggaaaattttattcatgaatcctgtaaaaagagatgttaattagcagcaaaaagtatccagagaacaataaaagtatttcagtactggaaacaatttcagtattgggaaaaggtgataatacttataaatcactactttcaaccttagatctttcattactgataaacattatattctcctgatagctccaattatttggaatacatcagcattctattaacaaatgagcaaactgggagaaatgcagcttcttatacaaaacaatcattaaagcaactgttttctgagctatgaaggtactgctcaaagataaattatactactaaatggttcatagccagtgtcatgataaaagttaagaaacttcactctcccagaagttttgttgttcaagctctaaatctggaggttctgcatttcaacttctccttctgacgctcacttactggtatcacttggctgcactgtgcacggaacatgaatgaaactgttgaaatgctaaaggaataccacttcaaaccacaaaggatttcctaaaagcagtgaccaaaatatttcctttaacattagtctactcattcagggaaacccagttttgattaaaattggggcaaccaagcaaggagttaaaaaaaatactctaagttggctatatctgttggaggtttaagtttttaaaatttttcctagcaaaccaagtacacactttaatagctatatggccatttgaacttcaaggagaaattaataaaaccagttattcagtcagtcagtatatatgcaaatggcaatattctaaagcagagatccattgtcaaaggtgtcattttgtcatccttatcacttcatttccttttaggactcattctgttccacactttcaatatctgaagttccttattaaggtgagtatcaccaccactatctccgacccccatcctccatcacccccatccccacagtctctctctctcatattcattcagaacatatttggtcagcacctacaccgcaggcattgtgcttggatagggtataaaaataagacagttcactattcttgaggaggtcactgtggcagtgggacaagagacaccaataaatacctgcaatctgaataaagtattgatacagtaggcggagtaaaatgggaagagtcaggaaagatgcagagaaatggcactggaggaggagcctcaagtgaggcgctacagagattgtctccaaaaacctgagaaacttcccctgaagtagaaaacaggggataagaataccaagtccaagtagtccagtcttagaccactctagtcactcacacttttaacttttgtttttaaatgctctgtgttgaaacagcataatgttctatctactacaatcaagagggcctatgtgatgtttaagttactctgatgaaaaaaaatctttgtgtccaatattaatttttcattaaggaaattaaagatgtttcaaagtctagatttaagaagcatgtggtttatgaagacattttaataatgggaaatgttcatgtcttggtattaagaggagaaaaattagggtaaaaaacattctacattaactttagaaaaatactaatacacatgtcccagatgccccatgagagtatttgttgcaatattatttataaaagccaacagccaaattcaaccctgtcaatgggatagggttggataaaggggagtacatccatctacctgagtcctatacagccaagggtaatgaagtagatccatgtgtatcaacttgtatacatctaaagctgagttttgttttttttttttaagttgcaggatgttatatttacaggctgaggttatttaaataaactaaaacaaacaactaccaattctccatggtaacaagtataggaaaactgtactgaaccaacatataccaaatttgcaaaagtaattgtttcagttagggcacagggccagggtcatgataggaaaagggaacagaagaggaaacagtggttaaaaatgactttatctggccaggcacggtggctcatgcatgtaatcccagcactttgggaggccaaggtgggtggatcacctgaggtcaggagttcaagaccagcctggccaacatggtgaaaccctgtctctagtaaaaagaaataaaaaattagctgagtgtggtggcgtgtgcctgtagtcccagctactcgggagaccgaggtagagaatcacttgaacccaggaggcggagcttgcagtgagccaagatcacgccactgcactccagcctgggtgacggagtgagactgtctttaaaaaaaaaaaaagactttaacactattaatatattccttttaaaaagggacaatgtgcttctatattatttgctctgtttaaaacatatgcacataaataagaaactgaaagtaagtacaaatgttaacagtgtagaattcttagtggtggtagtattttctccgctgcacttttcaaatctcatcaccacctcaccacacctgaaccagaactaggatcacagcaatgggaaaaggctagaagaaaacaggtgtggatggttgtcatgtttgcaagattctcccattatttctacttgcacttttggctctctgacatttctacaatgtgtaattttaatagttgagcttaaaaaaactccgaaataaaaagttatcatagtatcagctggccacagtggctctcgcccgtaatcccaacactttgggatgctaagacggacggattacttgatgtcaggagtttgagaccagcctggccaacatggtgaaaccccatctgtaacgaaaatacaaaaattagccgggcatgtggcgcccacctgtagtcccagctactcaggaggctgaggcaggagaattgcttgaacctgggaggtggctgcagtgagccgagatcatgccactgcactccagcctggaagccagagctagactccgtttccaaaaaaagttatacatagtatcaaacattctaaaatagactgaattacacaagcattaactagtgctgaactattttaagaaaaagccagtaaaaccaaccattttatttgaaatctcgtatcttaacactcttgttcaaataatacaaattcattaccctccccctaaaatcagaggaacctcaggttataaggtacgtggtcctcaagatcagttatatataggagtatgctgctatcactactgcagggaagctttctgatgagtggggaacaatgctgagccactatgtggtttaatgcaagagaatggtcctactatatgaaaaatattgcctgaagctactattaagaattaaaaatacgttcttgatacttaaaatcctgcctctgtgagaactctcaaaactaacacctaatgaagcaacgtctatggcaaaggttcccaatgctggctacagatgagaagcactgggaagttttcatttaaactaaaaccaatactcaaagacacaggacttaaggggaaatacctgtaaggaaaggtctttagaaaaaataagtcctacattagaaggtcaccagcattatggagaaaaacacagcaaaggaggaaaacagaaatggaaaggttggggcggggtggcaattttaaatgagatggtcaggaagggacttcctgagaaagtgacttgctttgaaggaggtgaaagaggagccacctggtaccaagaggagaggagaaggtcactatagagggaacagccaagtgcaaagcacattaggagcttgcctgatgctctgaagttttttcctgaaactgaagggatttgaaaaaggggcagaaaatgagaagtgatgtcacagaggtgatcagcatttggggcccttttaaggacactggcttttattcaagggagatgggggggccactgagactagtgcctgaacagtgacatattcacatacttggcttaacaaatggcttgtgtcctaaaataggctagttggggaacagctcaatcagctcacagcacctgagtgctggggaatggcagatctcaagcaaaacaaaatgggaatcctacagggcattatgcttcaacgatctgaggccacggggcatttaaaggtgttaagtcaagcaaataactatggtaagctttaaatgtttatcaaaacgtctctgaaagactaaggtgcctccctcattggacatgacctggagagcacacttggaattaacagtgtctatacagttttcaattaaatctagatttggcttagttgagtacaggaataaataacagaaccaaaaaggacttggtaaacatacgctttagtaataaatggtttggagctcagtctccagtgcccctgctaagtacagaacaccatctgagcactagtacagagggcagaatcacaccacaaagcaaagtactaaacagggacatgggttctagcctcaactaatcaactgcaggccctgggcaagtcacttcaccttgtggggtctgtttctttacctacgaagacaaatagttgaactatatgatctcccaaatctccactcttactctatttctgaaggccctatcagctctaaaaatctagcatttaataacaatggcaagcactctgagaacagaggaattatggggaaatatccaagagttaagtccttaaaggaaattaattctgtaaggcagcatttttaggtacagaaattttctagagaatacaaaaccaccaacatgataaaataccataaagagccacaaaacaaaccctctgactcttctaaagtaggcagaaacagtttataaccttgcctttgagggatgaacacaaccagaccaactctatcaagaaactttctactttctaaactaaaatgatctcttccaatactaggtgtttttttttttttttgagataaggtcacttcgtcacccaggcaggagtgtggtggtgcagcaccttgctcactgcaacctccgcctcctgggttcaagagattctcctgcctcagcctcccaagtagctgggattaccacaaccagctaatttttgtattttttcgtagagatagggtttcaccatgttggccaggctggtcttgaactcctgacctcaagtgatccacccacctcagcctccaaaagtgtggggaattacaggcgtgagccactgcacctggccctcaggcttaattgttagaaaaatatccaaagcaaatacatggaaaaaagcatatctccttgacatttgttcttagacaagctgtgggcagtgtttctggcaaagccatttacattctggataatgatgccaacaatggaactcctggacaaggaggggggagacagagaaagaacgggccagaaattcggaaaaggaatgttctcaggactgtgttgagttggccctggcatgttctccttccttttggcaatgctatcatcacattaatgaatatgtctgcaacaagggaattttcccaacacttgtttccattagaccaggaactattttcaagatattttaagagaacatattttgaaaactgcttttatggcaacataagtagaagtagcaggttatttttaatcttcatgatttaagattttattcactaccaggcattttctttttcttttctttctttttttttttttttgagacagaatctcactctatcactcaggctggagtgcagtggcgatctcggctcactgcagcctccacctcacgggttcaagctattctcctgcctcagcctctcaagtagctgggactacaggtgcccaccaccacacccagctaatttttttgtatttttagtagagatggggtttcaccatgttagccaggatcgtcttgatctcctgacctcgtgatccacccacctcagcctaccaaagtgctgggattacaggagtgagccaccgtgcccggccactaccagacattttctaacaacatatttcagtgatttgaccagattaaaatcagaactccttaagttttttggacagttattctctggcgtagttctagcactcgttaaaggggatggggaggatcgtacaacaggaataaatgtccagctaaaatgcttacccttctctgtcctgcgtcttttagcagaagggaattaggtaatttataattctggagaaggaatccaaatcacacttaatgtaaaactattattatatatcttaaaaaataaaaagtacagattacaacagaaaaatatgccttgcttttgcttgttccactccaatactcaactgctctagaataacaaatctcatgacccataggctaataggcagtgaaaataaataacattgtgctaagtcatgctgaaaaactggtttttatttcagcctctgtgtccagtcccaggaaggggtctatacagagttgcacacacttctgagtaacttctgacattggggtcaatatgtaaataaatgaggccaagcttcacctatttttccatctttgttccctttatttgagaggatattaatgatcaaatttgtgggtagatgaaatactttgggccaatcaccagaaatttcacctgtcagaattatcttgacaaaaggagaggttagacaaacgacttgtgaatcaaggtaaatccaccctacggtaaacgggtgaagatcaccaaaggccaaaacagcagctacatcccagggataaaataagcctaggctaaggtggttcagacagctgtggctgatgcaattgcattataagcttatgaattcctgtgagaaaacagttaagtgaatacattaagtcattctgatcgtctatcttcagaacaactgcccacataaagtagactgttcacaaccaaactgattaattctattttttcagtaggtataattgtttaaaatattcttattaaagactgaatctcatcttcccttgcagtatctcagactataaattatttaagggtaataacttggatctctgttcctagcacacagggtgaccagagtaggggtgttccaattgagtaagggtgggggggtgctgccagctccactagtgacagacattggccagctatgtgcaggagtccacaatctgatagattttcatctaacctcagacagccaggccccacctgaggcagcctgtgcccgggtagaaatctcttcagaaatctgagcctttcctactcaggagagatggacctgggcctgtctcttcttgggtgaggaaccaggcaaggagctcactctcaatgccctgtgtcatgggaacttctgaactgatcctgtgtgtgttcaggagatctaaactcaacaaggggtcctcttttctgtttcttcctttctctctggtaatatagagtctgaggaatgggctagatggataagaaaaggtcatttataactaagaaaaggtgaagtgttatccttcaatagcataacccttctaccaacctagtggattatcaaaacctctggcctactttcctttggtttcatttttgggagactaacttctgttttgttttcatagtttatctttcgatcgctgggtcgttcatataaccacactgttgggttcaggcagtacttattttcatggtcagagacaatacagtacagaatacattggacttgaactcacaagacccaactacaattctctaccactcttagagttgtagttaaaagatcaggctccaaaagataaatgtttgaggtgacagatatcccaattaccctgttttgatcattacgtattgcatatatgtaccaaaatagcacatgtaccccaaaaatgtgtgtaactgatgtaacaatacattttttaaaaaggaccaggctccagtcagaatgcctaaatgccactgtgtgagcctctggggcaatctacttcatctctttgcctttctgttcccttattcctaaaactaggttaaataatggtatctacacatcattaatcgtgaagattaaatgagttaatatatgtaaagcatttgaacagtaactggcatacagtaagcatgcagtaatgttagaattagcttaataagttaaatgaacaagtaatttcatcttactgtcttcatcctaaaactgattaatatttaccctatgtgtccatctcttaatgctcttacaagtgtgaagaacatgagaggatattatgatttacatatgtttcccataactctgtcacactagaaatggaaaatacaattataatttttatttttaatatttattatttgtgtgacacagccccaggaggtcctgagaacatgtgccccatatttattattaagaagaccatcctacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaaaaccaaaaaaaaaaaaaaaaaagaagaccatcctttcttgatgtgcaagcaaaaattagattaaaaaaaaaaaacatcctgactgcatttggtatagttaaaaaacaagcacacacacactaaactggaagccagaagatggactctgcaactagtgcgtagtcatacatctcagcctcatttttttccatccttaaaatcaggcaaattggatgtcataatctctaaacttccactaacaacacagttttcaccaacaccaggaatataagcaaatctcaaactgtgaacaggtttctaaaaagaactaagacattgcttttgttgttttcaaaagaatttcagtttaaagaaaaaggaagccaaaaatacttgttttcattatgacaccaaatcctaaagggaaagaaatagatttaatgccaaaaagatgtcagaataaccagctcaaaagctagaggtcacccaatacagagtaggaactaacctaggcagcaagtgtgatggaagttttaaatagcaaatgaaaagattatataataatgagctgtcaaaggcagaattaaaactggcataagtcaacttcaagaaagaaatggactgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaagaaagaaatggacaagtcctctgatagtaacaagcatatgcaaaagcagggttatccttagaggtggcagcctggggaatggggtgggaaagctaactgtactatttttactctggctaataacaagatgaaggtaaatgaatttagacattacagcctgctcacagcaggtttcacattaaaagggcccatttgaccactggcttctctcactgagaacttcagcacctggcttggcccccaagttgctctctgccccaactcctgtcatttttggtgacaatatagaccatactcctgacacccgggtctctctctctctctttttttttttttttttggagacagagtttcattcttgttgcccaggctggagtgcaatggcgcgatctcggctcactgcaacttctgcctccggggttcaagtgattctcctgcctcagtctcctgagtagctgggattacaggcatgtgccaccatgcccagctaattttgtatttttagtatagagacggggtttctctatgttggtcaggctggtcttgaactcctaacctcaggtgatccgcctgcctcggcctcccaaagtgctgggattacagacgtgagccaccgtgcccggcttgtttcttaagcttctcctcagtgaccttctattccattccacttcatgctccccaggacataccctgacctttgtcattccctccacaattacatatttacctccacaatcacaaatttagacatctcctatcctaccaatcccctgtccttgccaaaagcttcccaccccaggaatcattaattctttcacctgttaactgtaatccacagattctcccattttcttcccaactaccagccctcttatcttcactggcttcttactcagcttaagatttaagagccatcaccatcctcactctcaagcaatcctctgcaaatcccctgtcctctcccctccaaaatgcccatctagcaaagctaccacaggaagcatcattcacatttgctcaacttggacttgagggtaccagtaggtaggcattcattcactcacacgaatattcttctgcagaaagggcactgtatcaggccctgagtagtgagtatttgggaggacaggggtggtggtagcaaaacagacccaggggctgccttcatggagttcacatctactgagctggcagggaggagagacataagtaaacaaatatataccagtttatctaaacatgctcaacagcctttcttggactcagcatcacctacaatcttcccttcccctttctctagtgggtcgctcccccagtctcccatgactgttacattttaccacaatcctgcaaatctactttctttctctccctttgttcccctaactctctcctctagttctttcactaaatagccttgtcccttttctttgagaagatgaaagccaattggcaggattcttcattttccataaaaatttctaaactcctccctgcacacatactctttctccctgcctcaacagcttgcacacatgttcccctcttctcaaacaccaggcctctgggttctgatcctgctccctccttccttctcgatggtggtgctcctgcaattctcttcccaactccagcatcaccaagctctcccttttctaaacatctctctacaataagcactttaaaatccttcagaatcttccatttaaaaattaaaaacaggccaggcatggtggctcacacctgctgtcccagcacattgggaggccaatgtgggcagatcgcttgagtataggagttcaagaccagccagagcaacatggtgaaacccatggctacaaaaaatgcaaaaaaattagccaagcgtggtggcccatgcctggagtccaggaggtccaagctgcagtgagccacgattatgccactgcagtccagcttggatgatttccttaatggagccacatgtcttcacagcggtgtatgtctagaacaaagtttcttgaccttggcagccttgtccaagccaccagcatctccggctacaaaagcttttataactgtgcttctatcccgtcactgtgtcttgccccacagcagtagaatgatcattaaaaaaacaaaatcagacctttcactcccctgctgaaaactatgtaatctttctattacatttaaaatgaaagtcgagcctttaacctggcctacaaagcggtctgtgaactcaaccctgcctgccacttggcccgtgtgtcacacacctcacattttacccagttttccaggctggggcctttgtactcaaaatttcttctgcctggaaagctcttacccctgattttggaggatcagggctggtttttgttttgttttgtttttaatctttttaagtctcagcttaaatttactttgtcagacccttcctgaatatctgatccaaggtacctattctatccattaattctctgcataaagctatcagaagttttaaattttgctttatcttcgcactccaaaagaacataaagtattaagagagcaatttgttcacttctgtatctacagcacccagaataacgcccagctcgcagtaggtatccaataactttgtgaaactgattggaaggatgatgtatgccacagccaaagcctcagctgccagacataatttttgaaaaatgttattttcagaacaccagtaaaagagcttttaacaatggcttatattctcatagcattatctctatttatttttttacaaaaccttccttacttactagaaccttgtttctctctactggaattcaaaagatacttatcattggccaggcacgttggctcacgcctgtaatcccagcactttgggaggccaaggcaggcagatcacctgaggtcaggagttcgacaccagcctgggcaacatggtgaaaccccatctctcctacaatacaaaaattagcttggcgtgttggcacatgcctgtaatcccagctattcgggagactgaggcaggagaatcacttgaacccggggggcagaggttgcagtaagctgagattgtgccattgcactccagcctgcacaacagaacaagactctgtatcaaaaaaaaaaaaaaaagatatagatcactacagagtagccattatgtaactgtttgggacaggactaaagtcataaccacggttattagagaagtacacaggtgatctgaatggaattttgcctccccagccccaaaattcattttatttgagacggagtctcactcttgtcgcccaggctggagtgtagcagcgccatctcagctcactgcaacctctgcctcctgggttcaagtaattctccttcctccgtctctcgagtagctgggattacaggcacgcgccaccatgcccggctactttttatatatatatatttttagtagacacggggtttcaccatattggtgaggctggtctcgaactcctggcctcaagtgaacctcctgcctcggcctcccaacgtgctggtattacgggcatgagtcatcgtgcccagtcacagaattcattttatttgtgaaaatacagtggtacaagtaggcctttgttaaatgactaacctgaaacctcttgtgaatgacaaactcctctctactgcaaatactggcccatccctgcttaaatactgctcaatgaagttactcatgctagttcttgagggagtaactctagaatgattccatctaggaagacataagataaaatggtaagtattctaagttctataggtagtttagtcatgccatattataaacctccactccaaaaatagtgtgaggtcatttctggccagagtgaaataaaaaatgtataatgcctgaacagtctattattctgacaatgaaaaagattaatgcagttccctttatcacttgcatgagtaaaaaaatatatatatatattggctgggcgcggtggctcacgcctgtaatctcagcactgtgggaggccaaggtgggtggatcacctgaggtcaggcatttaagaccagcctggccaacatggtgaaaccccgtctctactaaaaaacacaaaaattagcagggcatgatggagcatgcctgtaatcccagctactcaggaggctgaggcaggagaattgcttgaacccgggaggcagaggttgcagttagctgcaatggtgctgccactgcactctggcctaggtgacagagcaacactccgtctcaaaaaaaaaaaaaaaaaaaaaaaaaaagaattatggcacactggttatcagagtatatgccagactgggagatttaagaggaactctgacaggctgtccagtctagtggaacagggcaacctaaaccatcctgatagtttgacccaattttaaaggccattaatatagctcagagttttttttttttttttgagacaagagtctcgctctgttgcccaggctggagtgccgtggcgcgatcttggctcatgcaagctccgcctcccgggttcacgccattctcctgccttagcctcccaagtagctgggaatacaggcgcccgccaccatgcccagctaattttttgtattttttagtagagacagcatttcactgtgttagccaggatggtctcgatctcctgacctcgtgatccacccgcctcagcctcccaaagtgctgggattacaggcatgagccaccacgcccagccagctcagagtattttaactattgtattgcccatgactttttcattttgtctccatttactcaaatgggtttggcaagttcttgcttcatgccactaacatcaaattcttttttttttttttttttttaatttcttgagaccggtttcactctgtcacccaggctggagtgcagtgatgctatctcagcacactgcaacctctgcctcctgggctcaagtgattctcccacctcagcctcccgagtagctggaactaaaggtatacaccaccatgcccagctaatttttgtatttttttttttagagatggggtttctccatattgctcagggtggtctcaaaccccttgtctccagtgatgtgcccacttcggcctccccaaaatgctgggattacaggatgagccactgcgctcggcctcacatcaagttctatggcagcacgagcttgctggttttgtacctgaccattctaccaacattcagcaaaccattcagcagtccctccagaatcctgttctcaaccatttctcttaccttcccagctttggtatcatcaaattgcaacccagaggcaatgcatacagcctgctcctagtagagggtcctcctcactgaaaatatgtagatatagatcggtagcatttcacaaattggtttctaaacttgttacctgtaccttataacacagttttctaatttttaagaagtataaatgatgacagggttcctaggctgctcttaaagttatttacaaaagattctaaaatattctatagttctatctgaaattaggatacaattctgttaatagtagccaataatcatttaaatgtaagataaaatgacatcttaattttatctggaatgctagtgtttaagtaaagtagatatgatatgaaggagaatataatagatccagaagagaacttctggatgttgcaagatctttagtggctataagccctgaatttaattttttttatatatataattttttttttttttttgagacagagtctcgctctgttgcccaggctggagtgcagtggcacgatcttggctccctgcaggctacgcctcctaggttcacgccattctcctgcctcagcctcctgagtagctgggactacaggtgcccgccaccacgcccagctaattttttgtatttttagtagagacggggtttcactgtgttagccaggatggtctcaatctcctgaggtcatgatccacccgcctcggcctcccaaagtgttgggattactggcgtgagccaccacacccggccctgtatcttttattagaagacttttatattttttttcccttggcttaggcttatcaaaagtatccccattatgattattagctctaaagaggggcatttttcagttcatatgaagagaaaaatgcaacaacggaagggggaagtggaagagtcaggcagaaaagaaaaaggtgagaagtacttgaggtaaccacccaagagaagagaaaaagggggaagaaagaagtgaagaaagttgcgcgtaaagacagtatctgagatggactaaactctaaactctaagcagaaaacaaaggaaggaaaacagtgtgtgcacttatacacacacataattaaaatttaaaggaaaaaagaagggaggctgctgggaaacacgtgggttaggcaggtcctgagcaagctaccacagggaattctggccaagcctgatggctttctagagcaaaagacagcaaagtgtagactcagacaatgatacagacaggacagtcaaaagacatacatttgcaatatgattaaaaatatttacttttataataaaagcaaacattgtagactatttggaaattacagaaaagtatgtttttagtctcctttaactgaacagctatggataacatcaatagtttggcattcaaatgtgaaatgtataggaaaaaattagagttgtactatataaaaaacattttcctgtgtgtcccttcaaagaggtgttaaaacatgactaatgggtaaaacattttatccactaagatgcactatcacttagctactttatcaccgactgggtcatttaggttgcttctgacttttaagtattataacactaaaatttacgtattcttttgacagtgcacatttctaaatatttctttagataatttttaactttttaaataaaattatttgaaggatataaaatatttaccaagcaatacatagtggtagactggctgtatcataataccttttctaacactgttttatctgccagtttgacaaatcatatactgtactttcgttttaatctgcattcttttggattagacataaaaccattttgtatcctctgcttatttttttttattaaaaattactctgtattaccctcttctatgagatcattcatctttatttcacccacactgtaactgcaagtctgtttggtgaaagctttcacttaacagctgagcacaagtatcaaaggctaaaaactgtgaacctcgagaagtgtgagctatggcagtctctgcagcaatttctttgcataaaacaaaatcttcatgaactggggattacttggggttctgaatgagtatctctaaagtcctcatgcacacctcaacaactctgaagcttttgtgaagacaatctctcttgtagaaacttatgtcttccttacgctctctcttctaaattgaggtgctgactcacacctctcctaaaaaacaatggaaccatgccattaagtacacgtagtattttatttacattcttcttctctcctaaccagtaaagatcttctgtagccttcgtcatgtccagcaggatgccaggtaccccgagttttaatacactggtcatatcaaacatgcagaatctgtttaattctagtatctcattttctagcagagaaaacaatgggtcagctgcatatctctctcatggtcaaggagaaccagggccagaacttctctaccctgataaccagtccactgaccaatcacactctcctaactcctacacagtaacacccagcagtattgctaagcactctaggaactaatgtttctgaatgaaaaatatgaaagtctgaattttcaagtaaatcagaaaaagattcaaatatgattcatctcaaagcagtctctctggaaaattatgcaaatattcagcgatgttatagttgattaaaggagttttatatcttttactcttttcaaagtgcctagagggccggttttataccccaattgatattactcgtttttccattcatcttattctttgggcttaaatgactgttagccatttcaaaaattcacatccagcttcaaagcatcaagatttgccatcacttatgatactgaaacagaagtaaaattccaaaaaaaagagctcaaagtgtttgaaacaataatggcatcataagaataagttcataacctcccaaggtgtctacctatattccttttctttccaaaaagtagctatgccactatttcgaatacccactcatttatagatgcaaattgttttaaagggacatctcatgcaatcatgtaactactgacagccctctaaaactatatttggagagtgtcccaaagataagcatatcacattatattgaatatatatatttaaatattcagagagaaatgtcttaaagagcatattccagaatgtaaataatgacaccctttaagggataagattatgagacattttgatttttctttactttggcttacagattttcttacattgctctaatggatatgggtcatttatacaattaaaatacacatccatacacaaacacacaaaatagaacaaagtacatagacactgcaaaattccaagagccaagcattaaagatgtttgatctaaatttgcacagctgattgtttaaaagctcaaaatttggctcaggaagaacactacacctacccagatacaacaggggcaagatttaaaaagaatgttgagattgggttgatcttacctcctcgcccttctgtataattttacaactatctacacaactcaaaaaggaatccttgccttttctaagtgagccacaacctttctgaatgcttaaagcacatctcaacagtaattacactgttgatgacctgaaaatgggtcaccccgcacaactgattgaaactctcttatgcaaccttcctctagaggaaacaagaacagcttgtacaaatatttcagctaaatctactttccaaacagaagatgatacacatttgtaggcattatcaagtcctgaaagcacacagaaaggcaaaagaaacaattatgaagaagttaaattagcttagtcatttgtcccaaccaaatttcatattgcatcattaatttaagaaagcgtggaggctttttgtgtcattagttaataaacaagcaatgcctaaagtttagacattattacctagaaagttatgatgagataatcatattatctagaaaaaatacattaaggtctgagaaataacatttctacaggatatgaaattgcatttctataagttcactcttagtttcaacaagctctattgtttcctttctgactaggaatgtggggttaacaaaactagacttagcatgccagtttttagcctttaggtaaacaggtatttatgaaatgtatctgaatgaacttgcatggacttctataaaggctttaaagtcctatcactaaccaacataagagttttaaatggctgagtagacagaaacaccctaaagttagaagatgaataaactggggacagggaaccacaacacaacagaaaagccctctcaaaaggagaaggtgtacaggcgtatacgtttctacacctatacaggtgctaagtcagatgtgctcgggggctgtctcaaaggctcaacacctcacagctccactcccactttaccattcacaacgctgaaacttagaggcccctatagcaagaaagaaatttctgattcaactggttaggagtgggggtgtagtggggagtggtctagactccaggatatcgggcattacttcttaagacagcccacagcagccaggcgcaatggctcacgcctgtaattccagcactttgggaggccgaggctggcggatcacgaggtcaggagatcaagaccatcctggctaacacagtggaaccccgtctctactaaaaatacaaaaaattagccgggtgtggtggcaggcacctgtagtgccagctactcgggaggctgaggcagaagaatggcgtgaacccaggaggcggaccttgcagtgagtcgagatcgtgccactgcactccagcctgggcgacagagtgagactccgtctcaaaaaaaaaaaaaaaaaaaaaaagcccacagcagtagcaaaatgtttgaactctggcaattctgaacatgaggcttagtctgattctcagagaatgctcaatatattacaattttattgttcttacttaaaattgttcaatattttataatattttagacatgtataaagtgaagcaaaaaaaaaaaaagctggcttaaattaactaaattactaccattctacagtctccaaatatttaaaggtgtccaccttcaatcagatagatctgtcactgagtgcctcaatgggggtgacaggtaaataacatcacccattaaggtaaaaggagatgaaggtgaggagaaagtacctctttgtacaaccccactgaggtttctattctttcttctgctgtttagggggctaaagagactggaggtgggaagactgcaaagggtcatttaattgtaaggtacccagagttggagtgaacaaaaaagcaaagtaggatctagggagaatttctgaaaatgataggattaaaacacatactatgtaacattcattcttgcaatctggcattcaaaattagacttaagatatgtttattattttcctgctaacagcttaaagaacagtggggccttaaagctggtttaatctgacaccaaaagacaaaaatctaaagtaatggtcattataattatgcaaagagtatatttaaacgtcttctaacacactatagaagttccccccaaaagtcactgattaattaaccaaagccaaaaaaggaaaaattcaattagacagccatttctggcattaattacctcccctgaaatgtaagatttttcccccttagatttcaaaactctctaaggagaaaaaccaagtagtaacatacctatagatggagatttgaaagggtatttatcaggtaggtccactctaactttccatactccgccttcatatggtgctgaaataaaagtaaaaatgttcatcagaactacatctccaaattagaaaataaatctgagtgtaaattaaacattatcccctaatcttctgaaaaccttccaaattaattccttcaagagtcagggacctactacaatcaataggtgtaccacgttcagattaagatacttttcttggaaagatccagagttaaaaaataagcagattcattctgcaatttacttgattcttcaaaagtactaaacactattcaattatttggtaagtaatagccatgttactttccctcctatctcaataaaccccatattcatcccccctccaaggccaaaaagaaaacaacaaaaaacatttcctggaaaccattcacgtggccatccataacaaaacccagaatttacaattcatgtctagtactgtcacatagagataaagagaaaactacagtcagccctctatatctgcaggttccacacccctggattcaaccaaccacagatcaaaaatattagagaaaaaaatccaaacaataataaataacaatacaattaaaaataacacaaaaaaaataccaaaaaggacaagtgcggtggggctcatgcctgtaatcccagcactttgggaggctgaggcgggtggatcacctgaggtcaggagtgcgagaccagcctggccaacatggtgaaaccctgtctctactaaaatacagaaatgagctgggcgtggtggcaggcacctatagtcccagctacttcgaaggctgaggcagaagaattgcttgaacccaggaagtggaggttacggtaagccacaatcgtgccactgcactccagcctgggtgacagagtgagactccatcacttaataaataaataaataaataaaatacagtataacaactatttacataacatttgcgttgtgttagctattacaagtaatctagatgtgatttaaaggacatgggaggatgtgtgtaggttacatgcaaattctatgtcatcttataaagggacttgagcatctgtggattttggtatgaggtggtcctggaaccaatcccctacagatatcaagggatgactgtatataaagtgattgtgataagagaaagatttcctcactggttctgcagtccaactaaacttgcttttcagaaactacgcatgctaccatctgtctttgatattctattaagaaacagagtaaaagactgtaatagaagaacacataccaacacatgtacttacttccttgtggtccataaaacttcactacaaattcattaagtcctcccaggatcgtaacctcatgtttactctcgatgctaaggtggacggtaaaggaaattacacaggctttacagtatctggcagaattaccaataacaccccaggcatatgccacttaaagtgttaccaaaatttggcatgacattgataaaatatacataataattctggtagtttaggaggaggcaatatatactcttgtaagaagatatgcatgagctttggattcagagacggccgttcaaatcccaggaatgccatttactgagtttttgagcctagccaaaataatgtcagtttactccctgagtctttgttttctctttgcaaattgggaaaacagcatttcataggatttctgtgaggattagacaggttaaacatgtaaaatgtgtaagactgcattttgcctatatacataaaaaactggccagacgcagcggctcacgcctgtaatcccaacagtttgagaggcctaggcgggtggatcacctgaggtcaggagttcgagaccagcgtggcctatatggtgaaaccccatctctactaaaaaatacaaaaattacccaggcatggtgatgcatgcctgtagtcccagctactcaggaggccgaggcaaaagaattgcttgaagttgggaggtggaggttgcagtgagccgagatcacatcactgcactccagcctgggtgatagggtgagactcagtctcaaaaataaaataaaaaatatacatgaaaaataggcgcttaattttagcttttctctccctttctaccctctcctcctcaatctatccctaatgagcctgtcatataaacccagtattccctttagtcaaattcaaatgttcagcaaaatacaaattcccctaaactggaaatgctatgctcctaaaacgagggatttactaaggagagttcccacaattgtctccttggcttatggaataatcaacacagttaatgatacaaccttgccacaagcagtactgccaaatgcaaaagaccaacaaaacaaaaaaaaattttttcagatcttatccatagcatctgttttcactgccccccaaactccaccttcttcagacttgcctcaaggtttggtatgctccagggctctaatcacagaggggtaacatggctgtgctcccttcctctaaaacttacctacccctgagattcttgcccctttaaggtgctaagattcaattctagaaaccaaattaattcatattagaagagaggactactcgtttaaaatctgttctatgtatctgctttgcggtaaaatccaaaaatgattctcagtaggaattttaggtgacagaggctttgggaagctctcaaatcccactgtaacattaaaaaggaaaacacaatagattggtctcatatttctccatcagcagtgcaaattatatactgttaatacaaaacagaaacatttaaaaagttttaataatctcatagagaataaatatttttaaagatttgaaattaaatatttggcactccaagcccgtgtccaatgagacacagaactgactgcaagaggccaggtgtaattttggtaaagtccttgctcaagagccctgagtatccacaagagatatttaaataagatagttcagtctaggctaatttgatctaattcttttctaaacgataacttactaccttagaaacatgcacactaaaatgattcaatactgtccacataggaaaactggctttatttcttgcttggtcaaatgacacatgcatgcctactctgaccagtcaccctctgacatcctgcaaaatattccaaagttaacgttaatgtaataagtaaaagcataacatgcttaaaatgttttaaaacttttttaaaaaaagcatccttgtgtcacgtaaaaaaaggcaaatccagttaaaataaaattaaatatcaacaatacagcccttaaagaaaacagacatggaaaacacttccatagtgtaaaagacaaatgataaactaggaagacaaaaatgtggattttaaaaataagttattacaaagcagcaagaaaaaaatacaaataccccaacaaagaaaaagccagaacatccaagtcaagaaaacggaaatgggtaaaactgaagtataaaaaagtccaattcattaaagaagtttaaaaagatatttcttcactataaacaatgaaaacaacgaaagagctggataaaatctagtgttcagtggagtacgaattagtacttctgaggacaaatccagcactatattccaaaacttaaaatgaatttactcttttattcaaatttcacttatatgaagttatttttttaaaaatagacactgctggtgagagtgtgatatggtttcacccactttgaaaaactgttggcagtactaaacctgcacatatgcataccctatgcctgtcagcgctactcccggagatacgcccaatacatatggatagttacattcaccgaaaccgatgtttaagaatgttcacaggactatttgtaacatccaaaaattagagacaatccaaacgttcatcaatggcaaaaagaataagctgtagtatagtcacccaaaagaaaattacaaagcattaaaaaagaaaaataggctgggcacagtggctcacgcctgtaatcccagcactgtggggagccagggcaggcggatcacttgagatcaggagtttgcgaccagcctggccaacatggcgaaaccctatctctactaaaaacacaaaaattagctgggcgtggtggcgggtgcctgtagtcccagctattcaggaggctgaagcaggagaatcgcttgaatccggaaggcagaagttgcagtgagctgagattgcaccactgtactccagcctgggcaacagagtgagactccgtctcaaaaaaatataacttaaaaaaagaaaaaagaatgaattgatacacataatgtatgggttttacagatttcatcaatgaactacaaaaataatttctctacaaaaattagccaggcatggtggtatgcgcctataatcccaacaacttgggaggctgaagcaggagaaacgcttgaacccaggaggcagaggttgcagtgagccaaaattgcaccactgcagtccagcctgggtgacagagtgtgactctgtctcaaaaaactaaataaaaaaataataaaaatttctgtactttggccaggcgcggtggctcacacctgtaatcccaacactttggggggccgatgcaggtggatcacgaggtcaggagatcgagaccatcctggttaacacggtgaaaccccgtctctactaaaaatacaaaaaattagccgagcatggtggcgggtgcctgtagtcccagctacttgggaggctgaggcaggagaatggcatgaacacgggaggtggagcttgcagtgagccaagaatgtgccactgcattccagcctgggcgacagagcaagactccatctcaaaaaaaaaaaaaaaaaatttctctactttttgtatatatgttattctttaataaaaagtttacaaaaataagtgtttctgataaatctgcatatatgtttcctggaatatttgaagtttaaaaatggaaacggtctaaacatttatcaataagaaactggttcaacgaattactattttttttttttttttttgagatagggtctcactctgtcattcaggctacagtgcagtagcatgatcacggctcactgcagtctctacctcccagtgatcctcccacctctacttccccctagctgggcctacagcaggcaccaccacacccagctaatttttttagtttttgtagagacagggtctctctctttgcccatgctggtcttgaactcttgggctcaagtgatcctcccacctcggcttcccagagtgctgggattataggcgtgagccaccatgcctagccaggtgaaatgacttataagccatttatacaataggtggctggctgcactggctcatgcctataatcccagcactttggaaggcctaaggcaggaagattgtttgagcctaggagtttgaggctgcagtgagctatgattgtgccactccactccagcctgagagagagagaacttctcttaaaaaaaaaaaaaggcaaaaaacacaaaccacatgcagtaggctactaatagtgtgtactggtgtcctctttccaaccagagctccactaatatatgtgtctgttcaacttgggtatccagaagaagtcaactgaatttagttgtacaaagatattccagcccttaaaactgacaaggataatgaaagaacggagtagtgcagaagattaaacgagtttaacaaaagaagtcttaaattaattttataacataaaaatccacagatgcagcattctccatcaatcagaactaatttgctatgaatgacactgatctactgcaattacttttaatcatttaaaattacgagttgtccttgtggatgttgcttctgggaaaactgaagataccttttctatcctttacctggatgcgataaaacgaggttccttccattttgcggtttgtttggaattc

SEQ ID NO: 14 - DNA, 8257 bp, Homo sapiens
taaatttaaaggcggggcggcctgtgagccctgaagtgccggccgcggagggtcctggccattttggtgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattcttcagaattccttgggaggaaatccaaagacacgtattatctgcacaattactccagtatcttttgatgaaactcttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatcgagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagttgaaggagaaaatgaaagaacttgcaactacatacaagcaaatggaaaatgatattcagttatatcaaagccaattggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctccgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaaaaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaacttaatataaaacaaattagtgaggttcaggaaaacgtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcaagaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgagccaaactatctatgcaagtgtgagatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttatggaaagcctgagagaaaagtgctctagaataaaagagcttttgaagagatactcagagatggatgatcattatgagtgcttgaatagattgtctcttgacttggagaaggaaattgaattccacagaatcatgaagaaactgaagtatgtgttaagctatgttacaaaaataaaagaagaacaacatgaatgcatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttag

SEQ ID NO: 15 - DNA, 7130 bp, Homo sapiens
gaattccacattgtttgctgcacgttggattttgaaatgctagggaactttgggagactcatatttctgggctagaggatctgtggaccacaagatctttttatgatgacagtagcaatgtatctgtggagctggattctgggttgggagtgcaaggaaaagaatgtactaaatgccaagacatctatttcaggagcatgaggaataaaagttctagtttctggtctcagagtggtgcagggatcagggagtctcacaatctcctgagtgctggtgtcttagggcacactgggtcttggagtgcaaaggatctaggcacgtgaggctttgtatgaagaatcggggatcgtacccaccccctgtttctgtttcatcctgggcatgtctcctctgcctttgtcccctagatgaagtctccatgagctacaagggcctggtgcatccagggtgatctagtaattgcagaacagcaagtgctagctctccctccccttccacagctctgggtgtgggagggggttgtccagcctccagcagcatggggagggccttggtcagcctctgggtgccagcagggcaggggcggagtcctggggaatgaaggttttatagggctcctgggggaggctccccagccccaagcttaccacctgcacccggagagctgtgtcaccatgtgggtcccggttgtcttcctcaccctgtccgtgacgtggattggtgagaggggccatggttggggggatgcaggagagggagccagccctgactgtcaagctgaggctctttcccccccaacccagcaccccagcccagacagggagctgggctcttttctgtctctcccagccccacttcaagcccatacccccagcccctccatattgcaacagtcctcactcccacaccaggtccccgctccctcccacttaccccagaactttctccccattgcccagccagctccctgctcccagctgctttactaaaggggaagttcctgggcatctccgtgtttctctttgtggggctcaaaacctccaaggacctctctcaatgccattggttccttggaccgtatcactggtccatctcctgagcccctcaatcctatcacagtctactgacttttcccattcagctgtgagtgtccaaccctatcccagagaccttgatgcttggcctcccaatcttgccctaggatacccagatgccaaccagacacctccttcttcctagccaggctatctggcctgagacaacaaatgggtccctcagtctggcaatgggactctgagaactcctcattccctgactcttagccccagactcttcattcagtggcccacattttccttaggaaaaacatgagcatccccagccacaactgccagctctctgattccccaaatctgcatccttttcaaaacctaaaaacaaaaagaaaaacaaataaaacaaaaccaactcagaccagaactgttttctcaacctgggacttcctaaactttccaaaaccttcctcttccagcaactgaacctggccataaggcacttatccctggttcctagcaccccttatcccctcagaatccacaacttgtaccaagtttcccttctcccagtccaagaccccaaatcaccacaaaggacccaatccccagactcaagatatggtctgggcgctgtcttgtgtctcctaccctgatccctgggttcaactctgctcccagagcatgaagcctctccaccagcaccagccaccaacctgcaaacctagggaagattgacagaattcccagcctttcccagctccccctgcccatgtcccaggactcccagccttggttctctgcccccgtgtcttttcaaacccacatcctaaatccatctcctatccgagtcccccagttccccctgtcaaccctgattcccctgatctagcaccccctctgcaggcgctgcgcccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgtccctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgaacacacgcacgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggttgaggttgcagtgagccgagaccgtgccactgcactccagcctgggtgacagagtgagactccgcctcaaaaaaaaaaaaaaaaaaaaaaaaaaaaaagaaaagaaaagaaaagaaaaggaatcttttatccctgatgtgtgtgggtatgagggtatgagagggcccctctcactccattccttctccaggacatccctccactcttgggagacacagagaagggctggttccagctggagctgggaggggcaattgagggaggaggaaggagaagggggaaggaaaacagggtatgggggaaaggaccctggggagcgaagtggaggatacaaccttgggcctgcaggccaggctacctacccacttggaaacccacgccaaagccgcatctacagctgagccactctgaggcctcccctccccggcggtccccactcagctccaaagtctctctcccttttctctcccacactttatcatcccccggattcctctctacttggttctcattcttcctttgacttcctgcttccctttctcattcatctgtttctcactttctgcctggttttgttcttctctctctctttctctggcccatgtctgtttctctatgtttctgtcttttctttctcatcctgtgtattttcggctcaccttgtttgtcactgttctcccctctgccctttcattctctctgtccttttaccctcttcctttttcccttggtttctctcagtttctgtatctgcccttcaccctctcacactgctgtttcccaactcgttgtctgtatttttggcctgaactgtgtcttccccaaccctgtgtttttctcactgtttctttttctcttttggagcctcctccttgctcctctgtcccttctctctttccttatcatcctcgctcctcattcctgcgtctgcttcctccccagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatggtgcagccgggagcccagatgcctgggtctgagggaggaggggacaggactcctgggtctgagggaggagggccaaggaaccaggtggggtccagcccacaacagtgtttttgcctggcccgtagtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaattctgggctggggtctagaagccaacaaggcgtctgcctcccctgctccccagctgtagccatgccacctccccgtgtctcatctcattccctccttccctcttctttgactccctcaaggcaataggttattcttacagcacaactcatctgttcctgcgttcagcacacggttactaggcacctgctatgcacccagcactgccctagagcctgggacatagcagtgaacagacagagagcagcccctcccttctgtagcccccaagccagtgaggggcacaggcaggaacagggaccacaacacagaaaagctggagggtgtcaggaggtgatcaggctctcggggagggagaaggggtggggagtgtgactgggaggagacatcctgcagaaggtgggagtgagcaaacacctgccgcaggggaggggagggccctgcggcacctgggggagcagagggaacagcatctggccaggcctgggaggaggggcctagagggcgtcaggagcagagaggaggttgcctggctggagtgaaggatcggggcagggtgcgagagggaagaaaggacccctcctgcagggcctcacctgggccacaggaggacactgcttttcctctgaggagtcaggaactgtggatggtgctggacagaagcaggacagggcctggctcaggtgtccagaggctgccgctggcctccctatgggatcagactgcagggagggagggcagcagggatgtggagggagtgatgatggggctgacctgggggtggctccaggcattgtccccacctgggcccttacccagcctccctcacaggctcctggccctcagtctctcccctccactccattctccacctacccacagtgggtcattctgatcaccgaactgaccatgccagccctgccgatggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccctaccggccaggactggagcccctacccctctgttggaatccctgcccaccttcttctggaagtcggctctggagacatttctctcttcttccaaagctgggaactgctatctgttatctgcctgtccaggtctgaaagataggattgcccaggcagaaactgggactgacctatctcactctctccctgcttttacccttagggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtgggatacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctcttatactgtggtttattctggtttgttacattgacaggagacacactgaaatcagcaaaggaaacaggcatctaagtggggatgtgaagaaaacagggaaaatctttcagttgttttctcccagtggggtgttgtggacagcacttaaatcacacagaagtgatgtgtgaccttgtgtatgaagtatttccaactaaggaagctcacctgagccttagtgtccagagttcttattgggggtctgtaggataggcatggggtactggaatagctgaccttaacttctcagacctgaggttcccaagagttcaagcagatacagcatggcctagagcctcagatgtacaaaaacaggcattcatcatgaatcgcactgttagcatgaatcatctggcacggcccaaggccccaggtataccaaggcacttgggccgaatgttccaagggattaaatgtcatctcccaggagttattcaagggtgagccctgtacttggaacgttcaggctttgagcagtgcagggctgctgagtcaaccttttactgtacaggggggtgagggaaagggagaagatgaggaaaccgcctagggatctggttctgtcttgtggccgagtggaccatggggctatcccaagaaggaggaattc

SEQ ID NO: 16 - DNA, 1575 bp, Homo sapiens
tcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcacccacccaggctacatggccttcctcacctatgatgaggtccaagagcgtctgcaggcctgcagagacaagccaggcagttacatcttccggcccagctgtactcgcctggggcagtgggccatcggctatgtgagctcagatggcagcatcctgcagaccatccctgccaacaaacccctgtcccaggtgctcctggagggacagaaggacggcttctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttctacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtcaaaaaaaaaaaaaaaaaa

SEQ ID NO: 17 - DNA, 1297 bp, Homo sapiens
ggcacgaggccgccttgtctctgggcgcggccatgttggaggctccgggcccgagtgatggctgcgagctcagcaaccccagcgccagcagagtcagctgtgccgggcagatgctggaagtgcagccaggattgtatttcggtggggccgcggccgtcgcggagccagatcacctgagggaagcgggcatcacggccgtgctaacagtggactcggaggagcccagcttcaaggcggggcctggggtcgaggatctatggcgcctcttcgtgccagcgctggacaaacccgagacggacctactcagccatctggaccggtgcgtggccttcatcggtcaggcccgcgctgagggccgtgcggtgttggtgcactgtcatgcaggagtcagtcgaagtgtggccataataactgcttttctcatgaagactgaccaacttccctttgaaaaagcctatgaaaagctccagattctcaaaccagaggctaagatgaatgaggggtttgagtggcaactgaaattataccaggcaatgggatatgaagtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagaaaaaaaaaaaaaaaaaaaaaaaaaaaa

SEQ ID NO: 18 - DNA, 4987 bp, Homo sapiens
gtctaaaactctcttttctcttggctcttcttattcgagtgatgaggaggaggagttgcataattcacggcccttccacagtaccttccacaataccagtgctaatctgactgagagtataacagaagagaactataatttcctgccacatagcccctccaagaaagattctgaatggaagagtggaacaaaagtcagtcgtacattcagctacatcaagaataaaatgtctagcagcaagaagagcaaagaaaaggaaaaagaaaaagataagattaaggagaaggagaaagattctaaagacaaggagaaagataagaagactgtcaacgggcacactttcagttccattcctgttgtgggtcccatcagctgtagccagtgtatgaagcccttcaccaacaaagatgcctatacttgtgcaaattgcagtgcttttgtccacaaaggctgccgagaaagtctagcctcctgtgcaaaggtcaaaatgaagcagcccaaagggagccttcaggcacatgacacatcatcactgcccacggtcattatgagaaacaagccctcacagcccaaggagcgtcctcggtccgcagtcctcctggtggatgaaaccgctaccaccccaatatttgccaatagacgatcccagcagagtgtctcgctctccaaaagtgtctccatacagaacattactggagttggcaatgatgagaacatgtcaaacacctggaaattcctgtctcattcaacagactcactaaataaaatcagcaaggtcaatgagtcaacagaatcacttactgatgagggagtaggtacagacatgaatgaaggacaactactgggagactttgagattgagtccaaacagctggaagcagagtcttggagtcggataatagacagcaagtttctaaaacagcaaaagaaagatgtggtcaaacggcaagaagtaatatatgagttgatgcagacagagtttcatcatgtccgcactctcaagatcatgagtggtgtgtacagccaggggatgatggcggatctgctttttgagcagcagatggtagaaaagctgttcccctgtttggatgagctgatcagtatccatagccaattcttccagaggattctggagcggaagaaggagtctctggtggataaaagtgaaaagaactttctcatcaagaggataggggatgtgcttgtaaatcagttttcaggtgagaatgcagaacgtttaaagaagacatatggcaagttttgtgggcaacataaccagtctgtaaactacttcaaagacctttatgccaaggataagcgttttcaagcctttgtaaagaagaagatgagcagttcagttgttagaaggcttggaattccagagtgcatattgcttgtaactcagcggattaccaagtacccagttttattccaaagaatattgcagtgtaccaaagacaatgaagtggagcaggaagatctagcacagtccttgagcctggtgaaggatgtgattggagctgtagacagcaaagtggcaagttatgaaaagaaagtgcgtctcaatgagatttatacaaagacagatagcaagtcaatcatgaggatgaagagtggtcagatgtttgccaaggaagatttgaaacggaagaagcttgtacgtgatgggagtgtgtttctgaagaatgcagcaggaaggttgaaagaggttcaagcagttcttctcactgacattttagttttccttcaagaaaaagaccagaagtacatctttgcatcattggaccagaagtcaacagtgatctctttaaagaagctgattgtgagagaagtggcacatgaggagaaaggtttattcctgatcagcatggggatgacagatccagagatggtagaagtccatgccagctccaaagaggaacgaaacagctggattcagatcattcaggacacaatcaacaccctgaacagagatgaagatgaaggaattcctagtgagaatgaggaagaaaagaaaatgttggacaccagagcccgagaattaaaagaacaacttcaccagaaggaccaaaaaatcctactcttgttggaagagaaggagatgattttccgggacatggctgagtgcagcacccctctcccagaggattgctccccaacacatagccctagagttctcttccgctccaacacagaagaggctctcaaaggaggacctttaatgaaaagtgcaataaatgaggtggagatccttcagggtttggtgagtggaaatctgggaggcacacttgggccgactgtcagcagccccattgagcaagatgtggtcggtcccgtttccctgccccggagagcagagacctttggaggatttgacagccatcagatgaatgcttcaaaaggaggcgagaaggaagagggagatgatggccaagatcttaggagaacggaatcagatagtggcctaaaaaagggtggaaatgctaacctggtatttatgcttaaaagaaacagtgagcaggttgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgttcttccccagtcctgaggagcccccctcgccatctgcaccttccatagccaaatcagggtcattggactcagaactttcagtgtccccaaaaaggaacagcatctctcggacacacaaagataaggggccttttcacatactgagttcaaccagccagacaaacaaaggaccagaagggcagagccaggcccctgcgtccacctctgcctctacccgcctgtttgggttaacaaagccaaaggaaaagaaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcaacagatgatattgagtgtcgggtggggaaggaggcccagactctgcttcggccatgatttgtgactgcccaggactctcaggttgggctggccctactcaggattacactgaaagtaatggcctcgtaagtacaggtgatggttttggacacgtcaggaattcctaaaggctgaaagagtgtatccaagtaaggtctgaacctccgactgccttttatttgggggaacacaaaaccaaacagcagatgttttggacttgatctgtgtacgtacatggggacctgtctgcatatacacacggggaatgccagaagaaggcccagtctgcaccaggcgtctggtcaacttagcacaagggcagtgcctggacggacccggagcccccgcatatcagcagttcacccagtactcctcagagactggtttccctctaaacccatcccgggcacataccacccctgttttgcatgtatttctcatttcattttagggatgacaaacatttgtgaaaccagtgagagaaggcttgatgtgtataaaagacgtgatgtgcaccacctcgatctcggtgtttcaggcactaaagcaacaaaacaacccatagtatctcattttgtcatcagatccagaagaaatatcctggttttccagcatgtttacccacatgttttgggcatggataaagtgaagagggctactcaccattatccctgcagcgtgacaccttttgattgtcactgaccactcagaaggggccacggcctcctggctgtgttcctgaggcaatgcactaatgtgtaaaaattaaccgaatgcaactattttataatggagagctcttaccttttccttccagtttttaaactggcataaactttattgacttcatcctcctatttttatagcaacctagttttagatggtacaagttgaatttctatcacaagacaataaaataacatgaaagcattatcctagttaatgctatttcaacttaagaaatatctacattgaagtatttgataataattgtaaagttacttaaccgtatgtcatgttcagacagtatgtagcagctagtaacgtgcctggcacagagttgatgcttaataaatagttgctgaataaatgaaaaagaaaaacctgcctttggttgtgcatactttaatcactttctgatttagaaaaagatcagtctagagctcactactgcacactacatcaaactttgctgtaaacaaaagtaacaacttcaaacagaaaaatattacctgttagtgatagtcaacttatataaagagcccacacatttctatgcaaataattaaatttgatgttctgatgtttaacccttaggtaaagaaggccaaagtgtgctgactggctaatttgtatgctttatagtaataatgattagttcctcaagcggccgc

SEQ ID NO: 19 - DNA, 188181 bp, Homo sapiens
gaattcctggcacccagaattgtgagcaatatgtttctgttgtttatataaagtacccagtctaaggtattttgtttagtagcccaaactgactaagacatccccctagcataaggaccgtatttcttagcctgtttgaagcttgtatggccaccaatgagatgtgaatgaaaataatgcatgcattgtctcggttatgcccttaaagggaaagggtgtgccctccactattttctttcccctttcttgccagaatgtgaagacaggaattggagcagccatcttgaactgtgagatggaagccatacattgaaggtggcagagcaaccaaatagaacgaccaagtgtctctgatggttgttgagctgtcataccagctgtggactgctgtctgaacttttgtaggacagaggaatacactatttaagtctgttgtaacacctgaattgctctgtattctaatataatacttgttttagaacacttggaacaacagaaaattagttttgttaaggcaggaaaaatcttatgtgtaattctatcacccagagtcagtcatgtgttaactgacatcttagtggatgttgtagcatgcttccctcagcctcatccccacctctaccttcacgatgacatgcttagttgctcagtgcctggagtgttagctgctaatggttctatccaggaattgaccttggcctcaggggggcagcctgcatccaagaatctgttgttgagagggtaccaaagtctagtcttcttgctttattcagtttggacaactctgaagggccatcctagctctagagctcgatgtagaagtggccaaggtctctgttgcaactgcattacagttcacctctccctctgtcaatccagcttccctctcctttcacaggcactcttcccaagggcacttcacaacaaacccgcatgcaaatctcagaatctttgtgctagggaacctgacctatgacatatacagatttagagatttgggattataatactttgtttttcactaaatattttgctgggtagtctccatttgcctttccagacacattctcctgccctccatccacctctgttctgggaggctgaccacgatgggatacattaatgagctcctttgccctctaccttccagttgaatgctgccagtggaaggcactgataggagatcagatggtgggaggacagagactgggatatccctcgtcaccaggctgtgtgttggaagaggcatcattcttctactaaatccacagctcatggtgtgaggtcttctcctagagctacaggtgttagtgttttgctggtagttacttcctctggccctttcatgcctaggaatggaaatagctccctagtgctgccagccctggggtgcttcatcagctccctggtttcttatccttgcccacaccttgcaattagtcagtcttctcaatcactccgtttgagtatgccatctatttcctggcaggaccaggactgatacctactattttttttttttttttctggaaacggagtctcactctgtcacccaggctggagtgtagtggcacgatctcggctcactgcaacctgtgcctcccaggttcaagtgatgtttgtgtctcagcctcccaagtagctgggactacaggcacgcaccaccatgcccagataattttttgtatttttagtagagacagggttttaccatgttggccaggctggtctcgaactcctgacctcagatgattcgcccccactcggcctcccagagtgctgggattacaggtgtgagccaccgtgtccggcctcctgtttcttttctttctttctttatttttttttttttttttgagatggagtctcgccctgttacccaggctagagtgcagtggcgccatctcggctcactgcaaactctacctcccagattcaagcaattctcctgccttagcctccagagtagctgggattaaaggtgcttgccatcacatccggctaattttttatatttttgctagagacatggtttcatcatgttggccaggctggtcttgagccttctacttcttaatgattcttctaaaacatgatttttattggccatgtataatttcatcatgtagacttaaaaggatttctttaattccctattgttatatatacactttttatattgatttttatcacaatacatcaaagcatttattatgccattgaaaacttccaataaacacatttttaaaggactgttatattatggctggaccgtgaaccttgagttgtttatccagtagtgctaagagatttgttctgatccacctgatttcttttgtgcagtgtttatagtgactaaagaaacgtattttcaagatgattgggctggctatactctgtagctgccacagaagaaagcaaggctatgccccaatcccaccacattaagatccccagttcagggctcttcattaaaacagctaaacaaactggtgtaaacagtacttttacttgaatttaacatcttttatgttttctgggccagactttgtgtggatattggataataggcttggtggcccttttatatcccttgtgtacttgtaattctaggaaaaatacaaagcatttagtgggaaggatttgtaagagaatacagtttgatcaccatgtaacttgagtaaaaatagcaccataattgaaaacactaagagtagggttttaaggaaagagagtaagattggaacaaagtaaccatgaacttttcagttctgagctgcgagttctgttcattattcagtgaccctttgtgagatcttgtcttagtccattcacgctactataacaaaataccatagactgggtgacttgtaaacaacaaaaatttacttctcatggatctggaggctgggatatccaagatcaaggtgccagcagattcagtgtctggttggggcttccttcttggttcatagacagctgtcttcttgctgtgtcctcacatggtgcaaagggtgagggagctctctagggtctatttaataagcacattaagggaatgccttaatgcgcttattaaatgaagttttttgagaaaaaactcaaagtgctttctaaatttatctcactcaaccacaatcagtgcagacctgtgaccaaatgtaggtggtgtgaggggtgggtgggtgggtgggggaggagcatctccccaccaccaagcaagcaattagttttgtagcagataccaactggatatcctccaattcagttctgacactatctacttggagatagcatcagatcgttaccggaaaggggtcctgatccagaccctaagagagggttcttggaaataattcagggcaagtcggcggagtaaagtgaaagcaagcttattaggaaagtaaaggaatgaaagaatggctacttcagagatagagcagccccaagggctgctggttgcccactttttatggttatttcttgattatatgctaaacaaggggtggattattcatgcctcccttttttagaccatatagggtaacttcctgatgttgccatggcatttgtaaactgtcatggtgctggtgggagtgcagcaatgaggatgaccagaggtcactctcatcaccatcttggttttggtgggttttggctggcttcttgactgcagcctgttttatcagcaaggtctttatgacctgtatcttgtgctgacctcctgtctcatcctgtgacttagaatgtcttaactgtcggggaatgcagcccagtagttttgaggcttattttacccagctcctattcaagatggaatttttctagttgaaatgcctctgacaagatcccacagattgggggctcagtccccaaggttccctcttaagccctagaaatcagtagcaagtctcggcctctggaacttctgaccaactgactggcttcaagtgggggttcccatgacccctccttgaattcaattaattttctagggtagctcatagaacttggaaacttacatttaccagtttattataaaggatattaccaaggatgcagatttagagatgcatagtgcatgcagcttccatgctgtcctgggcgtaccaccctccagaagtctccaggtgcttagctatctggaagttctccaaaccctgtttatttatttctatttttatttttaattttttttaatggaggcttcattcagtagccatgattgattaatcattggccattggagatcagcttaacctttagcccccctcctttccctggaggttagcgggtggggctgaatatcttaaacctgttatcatgccttggtctttccagtgaccagcctccatcctgaagctaccacctgggggttgccaggcatcagtcaatcattagcatatgaaaagacatcacttcggagattctgaggattttaggagttctatgccagaaatctgtgatcaaagaccaaatatatatttgttggttttctttctttttgagacagagtcttgctgtgtcgcccaggctaaagtgtggtggcatgatcatggctcactgcagtttcaacctcctgggctcaaacaatcctcccacctcagcctcctgagtagctgggaccacaggcacacaccaccatgccaggctaatttttgtatttttttgtagagatgggattttgccatgttgcccaggtctgtctcgaactcctgagctcaagcagtcgcctgcctcagcctccgaaaattctgagatttcaggcgtgaaccactgcgcccagcccaaatatatatttgttaatatcacagacattcatcccattcatgaaggctcagccctcacaacctaatcaccttttaaaggacccacctccagatactctcacattgggcattggatttcaagataggaattttagagggacataaacattcagaccatagcagatctctttacttaggttaaccttgttttagtattacaaaaagcacttcagtgtgttcattcattgtattcaaaacatatttatcaagaaactactatgttcaaaacactaggatatggctgtgaacatctagaaaaattacccactctcataccattaacatttctcaagggagtcggataactaacaaataaacaagattattgtgaattgtgacaagtcctagaaggaaataaacaggatgatgaaagacagtaagtggggcaggacactttagactggatggtcagggataatacaaacctcattttatgtgttatggaaggtagtgtgtttgaatggagtgagagaaaactagaactgaagtccagctttatcaccttgtataagtttcttaaccttgctgaacaccatgacaggctgaaaatataacaagaacataatgataataatccctactacttatagtagtagcagaattaaaccagagaaaactcctggcattgtaagcatgactttctgccaggccccacataaatattaatttcctgttaactttcctaaaattacatataatctgaattctgtaatacccatttccaatgatataattttaagaaactgttctatacatcttcaaatcaatttaattcatcaaatatttattaagcacttactatgtgccagtctctggtgacctgatggtgaatagaataaacagtatccctgcctggtcagggtttaattattgttcttatttggctgagactcacaaagccatttctgtccactggttctcctgactagtagtaatgaatttttaccccactgctatgcacattttatgttaaacttttttttgttgtaaaataaaataaacatttaaaaaggttcataaaacataggccataaatcttaaaatctgatggaccctctcttacaaaaccctatatacttatttatgtgtcagtacaaacgtctaccattctgccactaaaaataacaaagaaaacagaaaaatagaagataattttttttttttttttttttttttttggttgagacggagttttgctttttcacccaggctggagtatggtggcacaatctcagctcactgtaacctcagccttcgggtttcaagtgattctcctgcctcagcctcccgagtagctgggattacaggcgcccgccaccacgtcagtctaatttttgtatttttagtagagacagagtttcgtcatgttggccaggctggtctcaaactcctgccctcatgatccacccgcctcagcctcccaaagtgctgggattacagggaagataaattttgttgttgttgttgacagagtctcactctgttgcccgggcgggaatacggttgcacaatcatggttcactgaagccttgaccttccaggctcaagcacttctctcaccttagccttctggctagctgggactacaggcatgcgtcaccacgcccagctattttttctattttttttgtagaggtagagtctgttgcccaggctggtcttgaactcctgggctcaagcagtcctcctgccttggcctcccaaagtcctggaattacaggtgtgagtgaccattcctggtagaagataaaatctgtgaccaccgtttggtgtctggacagccttgtctcttgggcctggaggggtaaagcagagtcagtcacgcaaagtcacataactggcagagactccttgaatttagaacagtttgtttaaccaagtggaagttgtttttttttctttttcttggcttattatttgcctatagcggcagtgcccatcttggggcagatccaggtttcacaaaacttaccagggagacctggccccatagctctggaaatacttcatatggaaaggataaaggatatctatgttaaaccaacatcaacatgataatgatgaaatgctaaaggcaaatataactcaagctaggaacaacttacagatatttgccatcaccaccatttaacataaacggcccacgatccttatttccaaatcttgagttttaagtcaagttaataagctgttaaaggaaatatgttctgtatgttctatatctccgccttgataactaaacctttcatgacttataaatcaaacatacaaatcaaaattgtaaagctatggtttccatatgactataagttaacaaaatataaaaaatgattgaatttaataattgttatacatgtctgggtgttctgatgatgtggtagcatttttagatgagtaataagataatgagttgtaatttattctataaaatttattttccttgctttcatttcagcaaaatcattaagtttattataatcaagatattcatatcaggcacatggcttatgcctgtaatctcagcactttaggaggctgaggcagaaggatcacttgagcccagaatgttcaggctacagtgagctgtgattgcaccactgcacttcagcctgggcgacagagcgagacccggtctcaaaaaaaaaaagaaaaaaagattaacttcatttttttctattcacagtaatgacctcaaatattttaaaaatgtaattgtattaaaatgtgcctaatttgaacatattttcataaaagtaaattatagcaattgcaaaaatgtgaaatattaaattatatttttcaaaaatgtcatttatcttctaagatatctcaacttgtctattgtaagatgaactaccaattataatttatgaatgtatttaatctgaacatttaaactttaatctattgaaaatcttataatttaatcttatattttcatgaaaataaaattattcttaattttagtgctaagtgatcatctagttatcaaggtaaagaattggtatcacacttggagcatgttatagctacatgtacagatgttcacatttaagagtaatgcgagttatttctctagaatcacaaattggaaaccaaagagaagcaagatgatagatgctcaacacttccagaaagatacttccttatgcaagaatcttttgcattcgtttagtctaagagaaaggatttgacaaggtaatttgtcaattctttcacctaagcattcctacttagatcctcccagtagttggaagcagggtctgtctccaaggccacggtaatacaacatttagaaacagtaattttttattttgagaactcagggccagacatacaaagaaacatttctcagggacctgagtggtattagcaagagaatggatatttagcattgtgggttgcatttgccagttctaagcgccacattcggagtgacagaggcacttacacatattccttagtaagttaatttttttatatttttgttcatggggaccttatacagtgtgagccccaagcagcagacctcttgcttagccaagggcatcctggccaggacttccagttatataaaccagtaaatgttttcatgcttaagctagtttaaactaaaaaaagagaaagaaaaaaatcctaaatcatacaagtaggtagaaaatataacagaaaataagataccattcatggtagaactctaaataaaaatatctagaattaaataaacataggtgataaatacaaatatgataaatataattaaataaacgaatgtggtaaatagattatgtgcagaatatatgggaagacaatttactagcccttgctgaaatacatgttagaaaagcagaaaacttgaataaatgggaaggggtgctatgttttagaagaaaagactccatgttataacaatatcaattcatttcaaattaactaatgcatttaagcaatttttttttttttttttggagacaagagtttcactctgtcacccaggctggagtgcagtggcaccttctcggttcactgaaacctctgcctcccgggttcaagcagttctctgcctcagcctcccgagtagctgggattacaggtgcccaccaccacgcctggcttattttttgtatttttagtagagacggggtttcaccatcttggccaggctgatcttgaactccttaagcaattctaattataatgaaaattgtgattgtctccccaacatccattctatgccaggtctatgggtgcccctgattaatccaagcaaataatctaaatcctttccttagtcgtgattgataagagaatgggcaggtgacaggattcagattaatgacacacaaaaaatggtttgctggtagcttttactcttctgccagatgtgaatgaggatgcaatgatccaggctgctcctggcagccattctatgcccatgaggagatctagctgcagggtgagcttgacacagtggatggcagagctggaagataggagatgaaaatacatgtgttattcagtggtattgagggccattgttttgggaaaccctgaaatttggttatcaatgccaacaaatctctattgtttaagcctcttggaattgagcttttggttatttaccgcctaaagcatagggatttttttaaaaagaaacaacaaaaatttagaatgaggaattaaaaatcctacagtgattttagcagtctaatttaatacagatattggccagttaggttaatgaaatagaatagaaagtctagatagataaatatgcatttatttggtgaacaatgctgagaacattgatagttatttggaaaaataataaattcatttcctcctacaaaaccaatcatatgcagattaaaggattaaactattaaagagctggaagaatatacagacaccaagtcttagagttagtgagggcctaataagctgaaagtcaaataaaatatgaaggtgtaggatcgtcttgaagtatttaaaacattatatgccaaggaatactataagcaaaaggtaaattgttaaaatacagttgaaatatatgtattataaatataatattaaatatttgaaatataaaacactgcaaaaaacatccaaatataaaaaaagttcaggtagctcacaagagaagaaaaaacattgatctgcaaatgcatgcgaaatgtttaatatccctagtagttaacaaaattgaatataaagagagaacttttttaaaccattaaattggcaaagattaaaaagaatgctagcacaacattgtgaatgactaaatgtcattgagtaattgttcgctttaaaatgttgaattttatgttacatatgaaattcacctcaacttttagaaaaacaagaggagaaaaaaagaatataatggagtagccagagtgggaagtatatagagaaatagcttctctcaggcactgcagtttgtattgtaaattggtatgtaaattttgcaagactaattaacagtatgtagatgaagccttgaaaatgtttatattctttcctttcttcctataattacacgtatagaaatatgtacctaggaaataatcagatattagatttatatataaatagcattttgttgttgttgttgttgttatcgttttcagagatggagtttcgctcttgttgcccaggctggagtacaatggcgtggtctcagctcactgcaacctctgcctcccaggttcaagtgattcttctgcctcagcctcccgagtagctgggattacaggtgcccgtcaccatgcctggctaatttttgtatttttagtagagacggggcttcaccatgttggccaggctggtctcaaattcctgacctcaggtgatccacctgcctcagcctccccaagtgttggcattacaggtgtgagccaccgtacccggccaatagtgttatttttaaactgtgaaaattataattcgtgttcagtcatagcatagtagttaaataaattacaatatactatatagtaaaatactgttcattaattaaaaaaaaattatgtaaccaagtaatctttttgagttactgcaccatggaaggaagaggacaaaggcacattgtccagctttaagtttcaaattagaattttttttttcatccataggaaaataatagtcttaaaagctagccttgcctctaatttccaagaattcttcacacgtcaggaagaaaatttggcagcctgaatgtgtacgtttactataagccaagacgtaagggcacatgcaatctggggcaggtagcttcccccttctgaaggacagaaggaaggaagaaaggcttttaggggagctgttacagagagcagcaggggttcagattgcagtgtgtctctcttgccctcccagagttacaaacctcagggatgtcattggcgtgatccatggtggcaggccttggggaacccaagaacccaggagtggtctgtacttccttggtgtagtccgcacatcttgggagtggcagggtagtgttgccggagggagatgtctacgtggatggcctgagactacgtccagggattcacagcttgtgtgtgtgatgcagaaccaggggctgcttgcgaaagggctgagtgaacaggtaacagaaagagatgtagggaaggataagaaggtcacagaccagagcaaatagcaaggtccagggacatacatcagggctgccatgtgcctatgaagtcttggcagaatcagccattgcacagcaggcagcactgcatggtgcctggtaagcactgggcacaaggggcttctcagtagaggctggtgaggatccagggagccacacccagagaagaggccttccactgctatcagcataagccaagctctcctttgcactcttctaggtctgagggtgtcctccagaattcatgtgttggaaactgaatccctagtgccagtgttgggaggtggggcctaatgggaggagtttaggtgggatcctcactgatggataatgccgctatgaaaagggtgtgtgggaatgggctctacgtttcttttcctcttctgccatgtgagaacacaacatttctacccactggagaacacagccttcaaggtgctgccttagaagcagagagaccgggcacaaacctgtcgtagccctgatcttggacttcgcagcctccagaactgtgagagaaattaaatttctcctctttataaattatccaatctcaggtattctgttatagcagcagaaaagagacacacccaggtgtcatcctgggggaaaaggagtgggaagggagctttttggaagggagaaaatacagttctaatagagagtgtgaaccttaaatgatagcatatttacttaaaacacactctttaaaacctttaaaaatatccaggaactaatacatggagaaaagaatttaggatacatacacagaaactcaataaagttaaatattttttccatatctcagttcgtataacttgatttccttgaaatcatattttttaaaatgtttaaggaaattagaagatgctcactattatattgttaaaagagcaagcagtagatataatattcgaactttctaaaatgatagtagttattaatattatacacacaaacacataaacacatttttaaacctttgacaaatacttctaaatattaacaaggattatttctgggtatagaattttttatgtagtacttttcgtattataagatgaacatacatttcttcttataatcagaaattgttgtttaaagaaacaaaccatacagccttgctactcacaagtatggtccatggccagcaaccatgggagcgtgttagaaatgtggattctcaggccccaccccagacctcccaaatcagtgtcttcattttaacaagatccccaggattgtgtgcttgccagcagcactggcgtaggcttcacactcccgttcccagcctactgatgtccatacctgacgctctgctttctcctgtttctgcagacaaacagcccctccgctcgtactctggatcctagcccacctgcctacccaaggactttctcctgcacctgtcacctctctcttctcctggatcattcccattggcaaacaaacatgctgtgatatctctttcacaattttttaaaccaaattttattttatatgtttaaaatacacaacatgatgttctaagatacatgtggatagtaaaatggttactatagtgaagcaaattaacatacccatcatctcacagttgaccattttgtgtgtgtgatcagagcagctataatctactcatttagcaaaaatcccaaatataacatgctattattaactgtagtcatgttgtccattaggtctctagacctgttcatcctaatatctactactttttgtcctctgatctacatttccctgtttcctccccctcaccctccacctaaccactgccttattctctaactttgtatatttgactttttaagatttcacatagtaagtgatatcatgtaaaaattttctgtgtctggattattttacttagcataatgtcctccaggttcatccatgttgtggcaaatggcaggacctcctcttttttaaaggccaaattacatattctatagtattctatagatcctatattctctctataattctattatatttaatatgtatatctgtgttttttttccatccttctgtcaacggacattcagattgtttctctatcttggctattgtgaataacgctgcaatgagcatgagagtgcagatatctttacaaggtggcaaattcatttcctctgggtgtatacccagaagagagattgctgggtcatatgacagtactacttttaacttatttagaagcctccctactgttttacataatggctgcaccaatcttcatccccaccaacagtgtacaagggttctcttttctccacatccttgccaatacttgttatctctttttaattatggccagcctaatgggtgtgagatggtatctcacagcagctttgacttgtgtttccccaatgattagtgatattgagcatcttttcgtatacctgttggacatttttacgttttgttttttgagaaatgtccatttaggtccctttgcctattttaaaaatcaagttatatgttttcttgctattgagttgtatgagttctttataaattttgaatattaatcctttatcagatacagggtttgcaaatacttttttccaatccataatttgccttttcattttgttgattgtttcctttgctgtgcagaagctttttagtgtgatgtagtcctatttatttatttttgcttttgtagcctgagcttttggtgtgatatccagtctcatcctttaaaacaaacaaaacaaaaccccaatccactttccagacctctgtcttcttcacatattgtcccatttttttcctgctcttcatgtctaggaaaacttgaaagacttgtctctcattgtctcccctttctctcctccctttctctctcactaatccaccgatactgctcttgttaaagtcactgatgacctccaagtgttaagtccagtggccaattatctgtcttcgtatctcacttttacctctcagcaacatcttttacctctctcttctccttggctgccaggatactctactgccatgatcttctgcctctcttactgacagcccgcccctcccagtctccttccatggttcctcctcatctcctgtttctggataggctggagtcccagcgtatagtgcttttctccctctacagttccatggctttcagtctcctctataaatggatataccccagatgtttatatctagacctgaactccagagtcacatgtcaagctgcttcacttgagtgtctaacaggcatattaaacttagtgtgttcaaaaccaaagtcttaattttctcccccaactcattccttacccagtactccctatatgagcaaatgcctatatgagcaaaagtccctttcttatagttgctcaagtcacaagcttggtataatccatgaattttgtttctttctcttccatctctcagccattactaaattctgttctacttgcaaaatatatctggaatctagatatcaatttctcatgcccccactccagtgatcccctcctcagcctgagtcatcatcactctcttctgagactattgcagtagctgtaagactcagctccctgctttcccctgtgcccccaacagtcttttctctgcacaacagccaccctaaccccctttcactcagaataaaacccaaagtccttgccatgcagcagttcaaggccccatgtaaactgccccctgctctccgccgtaccatcctctctctctgatctgatcttttatgcccatccaccttgctccctgtactccagccatgctggcctctccttgctatttcttgatcttggcaaacaaacacacaaatgctgcctcagggtggcacttgctcttcccgctgacatgcagtagaacatagtggtagtggttaagagcaagactctttggagccagactctctggggttcacttttcagctctgctcttcactagctgtgtgaccttgcacaagttaattaacctttctgagcctcagttttctcatctataaaatggggataataaatgtacctatatacagtccttaagagaatttaatgaatttatgagaagcagttggaatagtcactggcacaggagtaaatgctgtgtaactattaaccattattattactggaggtgtccatataaccctctcatttcattcagagctctgctcaaatgtccccttgttgaagatttgtttgaataccctccctccccctccattattctctgtcatcttaacctgcttcatttttcttcttagcatggatcaatatgtaagcatacgcttgttattagacagataataaacatatgtagacaggtttgcctattatctgtccacccacaggaatgtgggctccactgagaaaatgctcacagtcctggtgtatggcaggcacccaatacatatttattgagtgaatttctgaccagtaatgtttccttcttcagtaattgataaatgtaattaatgacataaaatcttaaatctctcaaaaatcttgtttctacttaaggactcccaaatttaaatccaagaactaatacatggagaaaaaaatttaggatacatacacagaagacgtgtatatatgtgtgtatatacatacacacatatcagtgtacggaagccagctattctttcttgggaaatatttttttctcctgtatctgaaagtatgtccttctttttatagtgttagaatattctttctttaattaaatgctctagatagtagaagagagttttaaaattttccctagtatccctatatttattactgttttaaaatgtccctattacacagtacttatttttaatttttttaaatttcacatataaaatgttgtcaaccttatggtgcttttcaaaattaaaaattactagtctgtgaaatccgaaagtctgagcactgtttaaaatacaaatgaagataacatatccagttttattgatataagtttctaattccagccagaacctgggaagttgtgtcattagtcaaaaaactttgatgccactttgttcattatatcttacctgttatatttaaaaaaagaggcttgtaatattttttaaatagaagatgaaatatgggctttgtattagtctgttctcacactgctataaagaactgcccgagattgggtaatttataaagagaagaggttttattgactcacggttctgcatggctagggaggcctgaggaaacttacaatcatggtggaaggcaccccttcacagggcagcaggagagagaatgagtaccagcaggggaaatgccagacacttataaaaccatcagatctcctgagaactcactatctggagaacagcatgggggaaactacccccatgattcagttacctccacctggtcctacccttgacgtggggattattacaattcaagatgagatttgggtagagacacagagccaaaccatatcaggcttcaattagtagtccctatgaaaatattgcaaatgtgacttaaacatgaaaacaaaattgagcaaaacctttcacataatgctacacttggttcaagttgaagtcctggtttaaattgttttaagacttattgaagtgttaactgtccttttaaagaggaaaagagacctccattccctgtttgtcaagtaccgtactttttagttttattttgttctaataacagaagaagaagtggtaacatttgctgaatacttatgtatctgttaccacattaatatctttattatctcatttaattcttaaaacaagtctataaaatggaaatgatgatcaaacttcgttgatagaaggaaatgtaagtttagggagagtgaaataactcatttaaacagataccacttgttagatggtagtgctgggatgagctcccagagctgactctaccctccatctgaatcaggtgtgtatttcttgaattggcacacacttagtcgtgacaagtactcaaaagataaaataaaaattgtattgaatgaatacaatttagctttatatttgtttttttctttcagttgtattcttgttttgctcataaggccaaattttcatttaataatatgtgaatttatactcatgatgaaaatcaatcttatatttttaatctataatataggtgggaatgtagcctggaatgactgacagctgttattatacaaatagcacatgctggcaaaatggcagcaatttttgtgatctgtaattaggatattactgttgtctttatatctgcaaataagtagtaatgtattagaaagtaattggcataatgagttgggaaaaaatagaaacactctcatttatgattcatttaaaacttgcttaaacattatagagtaaaatattctgttcatgtgattttatttgtgctgtgcttaaaatattaaaaatcagatttccaaataggcatgatatatgaagccttaggactgatcatctttcaccccatcaacattttcttttttttctttttgagatggagtctccctctgtcacccaggctggagtgcaatggcacgatctaggctcactgcaacctctgtctcccaggttcaagtgatttctcctgcctcagcctcccaagtagctggtaccacaggggtgtgccaccgcacctggctaatttttgcatttttagtagagatggggtttcaccatgttggccaggctgatcttgaactcctgacctcaagtgatccacctgccttgggctcctaaagtgctgggattacaggcatgagccaccgcgcccagcccccatcaacattttcttttgggaacactgtgtaatggattttagtcaattctacaggaagtaaaacatcaatatttggaagtgaaaaaaattaactgcatacttttattgagttaaagctttcctttaactcagctttttcatccaggaggcacgttattaaaatcttgagtgcactcattgattatttttcttttatcaggaagtccataatgttatataataatatattatatgaacatatagtacaaattatatctattgagtaataagtaccatcaacatcaaagactatgttatttttcacctttaattttgttctttttttctctttaatatatttacaagttctgcaaacactttctgttgctttgtcatgttattatcaatttgtttgcaagtgtcatgtttggtattcctaactagatatgaaagctatttaggttaggaatgaactgtttccttcttttatgaacctttataccttcttacaatgctatccacatagtaggctgtcacttgactgtatattactagaagtgtatatattcagagttggtatcactagtggaaactctagaagctattttaggatgttgtgttttctgataatgaatattcaaatgaaggtaggaatagagagaaccatatgcattgacttatttttggtacctccccaaactaggtcagaatagagacctcaaaattcagtggctaaactgcttcactcttttctttttagtcatatttacaatggcagtttttgatcttcacagaacttcatgtgcatctgcctacagggtgtttctcttctgttggcctcattagctcctttgggaatgtggtcactgctataaaagggccgattgttagattctatggtatagagggcattgccagtcacaaaccaatttacctagcttcatggacctccgcagatcttctcagatccttaaacttctttgttgctagtgataattaactgagagatgatattaatattttagatatatatcctttgacagtcagcttcctttcacgactatagttaatagatttaatcccttaagtaagtgtcactggaagcccaagtaatactagctgaaacaaaagagagggtggtttttctcttacgtaagagaagtacagagatacacagttcatggctcgcatggcagttccctgcttacaaggatcccaaactccatcctccagggcacctcatggttgccatgtggcccccgcagccccagctatcacatccgcagccacgttgcaagaatgaagactggccaaaggcaaaaaaaaaaaaacaaaacactgtactaactgggtcaattgtctttaaagctttttcttaggagctgttattcagtgacatgtgcttcatttagttgcaagagaggatggttaaataattttttagaggggtacattgtcatcgttttgttgtgggtttttttttttttttttttttgagacagagttttgttccatcgcctaggctagagtgcaatggcgcgatcttggctcactgcaatttctgcctcctgggttccagcagttcttctgcctcagcctcctgagtagctgggattacaagcgcctgccaccacactcagctaatttttgtatttttagtagagacaaggtttcaacatgttggtcaggctggtctcaaactcctgacctcagatgatctacccaccttggcctcccaaagtgctgggattacgggcatgagccaccatgcccggcccacattgtcatcttaattaaaattggattttattactaaagagaaagggctgaatgtgtattaaatgggcatctagaacttctgccataccttgatatttaacatattttattttttcagacagggcctcactctgtcagccaggctcaagggcagtagcacaatcttggctcactgaaacctccgctcactgcaatctccacctcccaggctcaagccatcctcccacctcagcttcccgagtaactgggactacagacttaacctattttaagatttgtcctttaaaaaaaagatttgtcctttttcccaaatgagccatggatgtgtgctttatatggctttgtttctgtggtaaacatacacagacctccagccaagatttaattttcttcttctgatgtgattatttcaattttttttaagatttggtgaattacattaaataaatatttattaagctcctctcatcatcaggatactgtgctagatagggattctcagctttggtgctattggcatttggggctggataattctttgttgtgaggggctgtcctgtgcattaggatgtttagcagcttctctggccttcaccctctagttgcaactagcaacccccagtcgtggtcaccaaatttgtctccatatattggtcacatccccagtggggatgaaatcgcccccagaggaccatggtgctagaagatagccccacatttatgtgaattgcctgtttgatttcctgtgaaagtgtatcatggtagattaagtgttgcttgaactgttgcttgctgttggtattacgagcgaagtagtactggtggaattttcatgtgtgctggacaccatgatgagaactgtccacgtgtcacctcatttaatcctcatagcacaacactgagttaaaacagcactgtgttaggagaaggtactaacaagattaggtagtattataacccccctttacagaggagcaaaatgaggcttagagattattttagctgagatctccctgagagcaagcctgagacagtgagtggttcgttgggaggtgatttcaggaagcagaatgatggagaggggagaatgaaacagggaaggaagaaaagctaatacaggagttgatgttgggttgagagctacctcaggggtcacccagggcactgtatatctgaggactctgaggaacagtgaacaatgcatctcagaattagttctctctcccactccctacaggggttgcgggggaggaagctggaacttctccacgtactcccatcttccccaggggcatgaaccccctttccctttacctataagagtagtgagcagtatacacaaagatccagcttttgaggagcttatagtcttgaggagaaagcaatacattagtaagcaacatagtatccaaaaccaatgcatgctctgagaagacagaacgaaggttgtgtgacaggagtgcttggggaactccttagatggggtggccaggatgagggatgagctgagaccccaatggcaaggagaagccagtcatacaaagatctagggtaaaggcattctaggcagaggaactgcatggtgcaaaggccccgaggcaggaacacattttctttgaggaataagtagaaggctagtggggtggaaggctgagaggaaggggatgtgtggtggaggatttggtcaaaagactggggagggacagtcaggtcttgggtaagaaacatattttattgtgcgtacttcttcctacactggagggttttaagcagggttcaagtgatctgcttaggattttattttattttattttattattttattttatttatgtatgtattatattgtattgtattgtattgtattgtattgtattgtattgtattgtattgtattgtattgtattgtattgtattgtattgtattgtattgtattttaagacagtttcacttttgtcacccaggctggagtgcagtggcacgatcttggctcactgcaaccttgggctcccgggttcaagtgattctcctgccttagcctcccaagtatctgggattacaggcctgcgccactgcacatggctaattttttatttttacagcatggtttcaccatgttggccaggttggtctcaaactcctgacctcaggtgatccacctgcctcggcctcccaaagtgctgggattacacgtgtgtgtgccactgcgcctgggcaacttatgattttaaaaagaacactctggctgctgtggagaaaggagtgtggcaggggaagagaggaagccaggaaccagttaggaaggaggctatcatatggttcccacagggccagctacatagtttgtggggcctccagcaaaatgaaaatgtgggggctcttgttcaaaaagcagggggaagagagtactattaaaggtactaaactataaaactttttgtttcacagtccatcaacttgtcatggtgtgtttttgtttgttttgttgtttaatgtcattctaagtaaagaaaaattaaagcttaaaatattagtatgaattttaccattcatctgtatattgtgcaatgctggttttaaatgcaaatataagacatttttagggataaaagacttataaaaaatgaacaaaaaccaataaatcaaagaaaacatttagctcatatccagaatcactgatattaccgaacttacatttcatagttcatacatgcatatgtactttgttcttaccagaactgtggaaatgtggcacaaaacaagctcaactgttttatttcacttctcgttccgtgcccattctaccaacactctctcccctcagcttcctggtagataaaagatgggcaaggaaaaggagctctgggttgccctatgattccctttccttctctcgtcattttcagcatgggtgctaggttaacacagggaagtaacacaaataagagaggatattatagggtttcttggtcatttaggtttctcagaacaccattgccttttttctgtgctcacagtcaattctggttcaaaaggcaagcatggcccatcagccctgtgaacggtccttgctcgctgagttgtagatgtaacactcttacttcatacttgcttctaggctcactaagctcccatgcattgtggtaagctaaaattctgtgctcatgggacatcgtgaacaccatacccacatggggtcttgaggaaccacagacacacatggcacctgtctcctctgctcgtgcacacgtgtcattgtcccatcagatttcacttgcccaagatcaaagattattaagattttcaggatggtgacagcagagcatcagactaagtctgggacctaagtgaggggccctgaaccactgcacaggctacacacccatgaggcctagatcctggtgagagaagacaggatagagacttggctggtacaagtggagaaaaacaaagtgttgagtaagttttggggttagatggtattaccaagacttgttgtggattggatctgcttttggatagggacagaagagaaatcgaggatgacttacttctaggcttattacttaggaagatggaaaagactataggagaaataatttttgaagtgagggaaatacagagttgtgaagtttggatttaccttggtttaagaactatggagctgcagagccaggatttcaacccaggcagcctgacttcagagtcagtgcctttaaccactgcactgcactgttctgtcatgcgggacccacgctgatgggtgcctggtgatcgttgcaatggttctgtatcttactattctctgccctctctggacgatccaccaactgtgtgcagtgagcatccatgcagaggcatgcttgaatttaaacacagttttgtattgaaacctagttaacaaatattcctttaactcacaagcttctcttttgcatctcaattatatttgtttttatagaaaggatatctttatacagctttgctcattcacatgaaaaggaaagtgtgttttcagttggaagatgtggagtcaaaaaatctgaagctgagtttggtatctctcaattgctagctgtgtgtccttgggctaattaattgctttgatctttggtttcttcatctataaagtacagatggttttgtgtgggtgtatgtgtttatatgtgtgtgtacatatatacatgtgcatatatctatatatatgcacatacttgccctcatcatatacaaggctactgtgaagattaaatgagattatagaggaaatccaactcaacaaggcttgagttggatacccattggcagtcactccctatttccctctaccctcaaaccctggcaaccactaatctactgtctgtctccatggatttgcctattatggacatttcatataaatggtatcatgcaatatatgccctttggtgtctggcttctttcactgaggataatgttttcaaggtttattcatgtagtagcatgtatcagtgatacattatattttatggccgaataacatgaatatgccacattttgttgatccattcatcagttgatggatatttgggctctttccactttttggctattacaaataatgctgctatgaacattcatgaacatacttttgtgtgtacatatgttatttgttctcttgagtgtattcctaggagtagaattgctgggttatttggcaactctatgttaactttttgaggaactgccaggctgttttccaaaagtgtctgtttcattttgcattcccactggcagtgtatgagtgttctaatttctctacatcctcaccaacacttgttattttgtcttttttattataactattctagagtggtaagtggtatctcattatggttttgatttgtatttccctggcggctgatcatgttaaaatcctttcatgtgcttatcagccatttgtatacactctttagggaaatgtctatccagattctttgcccattaaaaaatttgggttctctctctctttttttttttttttgagacagagtctcgctctgtcgcccaggctggagtgcagaggcgcaatctcggctcactgcaagctccgcctcctgggttcacgccattctcctgcctcagcttcccgagtagcagggaccataggcgcccgccaccacgcccgactaattttttgtatttttagtagagatggggtttcaccatgttagccaggatggtctcaatctcctgacctcgtgatccacctaccttggcctcccaaagtgctgagattacaggcgtgagccaccacgcctggctggttctctttgttttaattgtcgaatagtaagagttctttatatattttgaatactagaaccttatcagatatagaatttgcaaatattttctcccattctgtaggctgttttttcactttcttggtcttgtctttcgaagcacaaaagttttaaaattggatgatagccagcttctttttctttctttctctttctttctttctttctttctttctttgtttctttctttctctttctttctttctttctttctttctttctttctttctttctttctctctctctctctctcttttttcttttcttttctttcttctttttttgagacagtcttactctgtcacccaggctggagtacagtggcacagtctcagtcaccgcaacctccaccttccaggttcaagcaattctcctgcctcatcctcccaagtagcttggattacaggtgtgcgcccccacgcctggctaattttgtatttttagtagagacagggtttctccatgttggtcaagctggtcttaaactcctgacctgaggtgatccgcttgcctcgacctcccaaagtgctgggattacaggcatgagccactgtgcctggcccacttatttttcttctaagtttctgcttaaagccctgacgtttaggtattcgattcatcttgagttaacttttgcatacagtgtaaggtagaggtccaatttcattgttttgcgattggctatccagttgttccagtcacccaggctggtgcagatcgtgcagtggcacgatctcagctcactctccgcctcccaggttcaagcagttctcctgccttggcatcccaagtagctgggactacaggtgcgtgtcaccatgaccggctaatttttgtattttcagtagagacggagtttcaccatgctggccaggctggtcaaactcctgatctcaggtgatctacctgcctcggcctcccaaagtgctgggattacaggcatgagccactgtgcctggcttttttttttttttttttctgagatggaatcttgctctgtctcccagtctggagtgcaatggctcgatctcacctcgctgcaacctctgcctcccgggttcaagcaattctcctgccttagcctcccaagtagctgggattactggtgcccaccaatacgcctggctaatttttgtattttaagtagagacagggttttgccatgttggccgggttggtttcgaactcctgacctcaggtgatccatctgcctcagtctcccaaagtgctgggattacaggtgtgagccacggcgcctggctttttttttttttttttttttttttttttttttttttttttgagatgagtcttgctatgttgcccacgctggccttgaacttttgggctcaagtgatccttccaaggagctaggattacaggtgaacaccactgtgcctggctcagacagtcttgattactgtagttttatagtaagttttcaaattgaaaagagtgagtcctccaactttagacttctttttagattgttacggctattcgtgttgccttgcaaatccatatgaattttaggatcagcttgtttatttctgcaaaaaaggctgttggaattttgataggtattttattgacactatagatcaactttgggagtattgctatcttaacagtattaagtcttccacttcataagcttgggattgtctttttatttatttagatctttttaaatttcttccaacaatgttttgtagtttcagtttatagtcttgcacttcttttgttaaatttattcctaaatatttattcttcttgaagatactgtaaatggaattatttgcttaattttattttaagattgtttattgataatgtataggaaaacaatttatttttgtatttgatcctgcaccctgcatacttgttgaacctgtttactacttctaacaggtttttggtggagtcctcagaatcatctatatataagatcatgtcatatgcaaatagagatagttttacttcttcctttctaatatgaatgacttttatttctttttcttgcctaattgctctggctagagttccagtaattgatgaatagaagtggcaagagtagacattcttgtcttgttattgattgtaggggaaaaataatttgttcttttataatcatgttagctgtgggtttcttgtagatgccctttctcaagtggagaaagcttctattactaaattgttgagtggtttttctcatgaaagggtgctagattttgttaagtgctttttctgcatctgttaaattggccagttggtttgtttttcctttttctactaatatggtatattaccttgattgcttatcatatgtcaaaactggaatactcttctaatacccccttttttttttcaaaaaggataagtggtgatttactttctgaatgcttataaatataaaatttcttccaatcaccttatagattatattaagcttgtccaacccacggcccaggatagttttgaatgcagtccagcacaaattcacaaattcataaactgtcttaaaacattatgaggtttttgttgttgttgttgttattgttgtttttaagacggagtctcgctctgtcaccccggctggagtgcagtggcacgatctcggctcactgcgacctctgcctcccacgttgaagtgattcacctgtctcagcctcctgagtagctgggactacaggcatgtgccaccatgcccagctaaattttttttgtatttttagtagagacggaatttcaccatattggccaggctggtctcgaactcctgacctcatgttccgcccacctcggccaaagtgctgggattactggcatgagccactgcgcccggccatgggatttttttttttttatgattttttttttcagctcatcagctgtcagtaatattagtgtattttatgtgtggcccaacgcaatttttcttcttccagtgtggcccagggaagccaaaagattggacacccctggattatatcttgcctggacacaagattcttggaatgcagtccttttttcttaaaagtttatatacttattctaggttccagtgtggcatatgaaaggtccgatgccagttgtcattattttgcttttataagtaaatatcctgttcttgctgtcttgaagcctaaaagacttgttctttctagttggagtttaaaacttcaccataaaaatgtgaagaatgtgtcttttatttcccttataactgcctggcattcggtgagctcctttgatctaaaaaactcaattctttcttcacttcagggttttcctatttgattattgcttctgctcttttctctcttgctggaaatgctatttgcttattaggcctcctgaatctgtcctgtatgcctgttatattttcaccactgattgacatttcattatttctgctttgtgatgtgatagttcctttgcttcatattccagtttactagtttggtttttaataccagccattcattttacatccttttggaacttaagccccagagttcatgtttctcataggcaccttctccttgagttttcgtagttattctccttgtgtatccccttaaacattcttattacatttttattgtttcttccattaatttggcttttgtaaaagttgcctatctctccattctggtttccctcctttgaattgctaagtcccttaaatgtctacaaagtttctttgctttgttaggtcagggagtatgtattctcaagcacctgcataggcatggtgggtaaagtctgtgaggccatggtggatattgccagtaacccatgggagctggtctaaaaaattctgagacagcatctgggcctagagagggaaccaccagaaaaagcagtcagcatctgagatgatgcccggagagaagcagatagaccatctgcaaggaagagaaggcttggtttcttagagggtgacctactgttttctgttcttgtccttggtttctcacaaaacctttgcatatcctcttatgacatcagtatacattctcctctccccgcctactcctattatacatctacccttcacctctttgagatggcttgagttgatctgtcttcccagatgaggcagcagtcacatcctgttgctgtgaggtattttcagctcttccacaaagggcctagatggtaaagacccatctcttcaaaattctttctatagtgacttagatttaccttcccaagtatctcctttttaccaatgtcttccaaatattttcattcctttataaatcccttttctgaaatactcctcccctctacccctctgaagttcaactttcttctcagagcctttagtctacacagatttaccagagtgtttgcataattgggtcaggatattcatctgcagctaattttgcacttttaatgtgatacaagctttggtttagggttaatttgtatcaataattatgaataatgtacttatcaaacataaattccttttttgagtgtatatatttcctggatatttatggccatgttctctttaataattcctatatttatcattctaatttacttctattgcctagtccaaggatcattctgcctagtactgattctgcctagtactgatgcattcttttgagaaggaataaagttactgcattattttaatgtaagcttgctttttgatggggcatgcacactgcctcctcaccctcttatacctgaaactttccatatttttgttaattcccctgtccttgaagacatttggattttaagtttggggccttgggctcagtatatcgttgtaatttatttgtttgcaaataattttcttaaatattcataatgaatgacattgtgcattagaggcagataccatgaattgtaatttagatctgttatttaccaccattgctggtcgtgcttggaaaactactttgaattattctcctatccacttaaaatttattttcaagtcctgtgattctaaaatgcttttattcagattatgttatcatatgttcttgtttaattaggttgcctgtcactttgctaaaggtctaattagaaacgatatctctattgtgtttgattcagaatgaatgtactaaaaggcactttgaaaataagataatgtcctcgatgatgatatcctttatttatgccaggtgcctattagtattttgtaaactctccatttcactttagctcaatctaatcctctttgtgatttttttccataattgtagagtaaataaaattcacctactggctccaaaatgtaatttagaaatgcaaactaaatgttcccctgtagggggtgcaatctgttttaaactctcaatatgtgtaatgaaagctataaaccatagagggaactttcgtgggttccatccatattgttcggggcaggctttttgagtgatttgaaaactttgtaaatttgatggtagccaatgtttttctcaagttataaaatttacataatattaggatgaatgcagtacatttatttttttgttatgatttggggcattgtattagagttctctagagaagcagaaccaattgtgtgtgtgtgtatatgtgtgcatgtacatgtatatatatgtatatatgtagagggaaagtatgtgtctgtatatatgtttatatagatatctatatatagatatataggtatatatatgcctatatctcaagttattatatgtacatatatacaacatgtatatgtgtgtgtgtgtgtgtgtgtgtgtgtgtgtgtataaagagaatgtgaggaaatggctcatgcaattatgatggtgggcaagttggaatttgtagggaaggctggcaggctagaaattcaagtaagagttgatattgtagtcttgattctgaagcctggaaatggttagaacttctatgttgtagtctggaggcagaatttcctctctcagaagcctcagtctttgttctttaagttcttcaattggttgggtgacacccacccacattatggagggtaatttgctttacttaaattcaactgattgtaaatgttaatcatatctacaaaatacttttacagcaacttctagactaaaatttgaccaaacaattaagcaccatagtctagccaagttgacacataaaatgtaacatcacaggcctcttgcatatgttattgtcagtaagccaaattaaagataatggtagctagcatttttactaacttggattcaatatttagtgcaactctgcagtaataaagatgtgaattatactgtagcactccaaaattgagtgaataggacatgaaacaaaagccatgaaccatgattcttatcagtttggattttttccagaacattttttgagtcggtcttctgcaatggtattgttctagtttgttctttgaaactcagctttcaagttctgtgtgtgcattcaatattgggcaattttgaacgcatacttagaagagcggccaaaatgtagattagagagagaaggtcaaacaacttctcatcctgtgcaatttctgcaatcctaagcctgttataacacagagtgttccaggacctcccacagatccatgaaatgtattctctgggttatggtctgcatgtgatttgctgttccttgatgtcaagcttgctgttcatctgaccctcaagatccagtcagagtcttcagtcacactcaccctctaatttttttgtatgtgtgtcaccaagtttttgtcttctgtaattcagttcacactaaaaaaaaaaaaactttttatttcccccctatatccctaaagtggttcttcctctttccctcccctcttcttccctctgtctctctgatttctcagtttgatcctgatgtgaataacatactacccttagtcttacatttctaatttttactttctgtgggaaacttccatctatgtttttcttttttcttttttaaatccttagcatagtaaatggaggtttgttgtgtgggtgtgggagccgggggtgcagggggtgggatgtttctttttaattgttagagcttgatctctacatgactttccattagcttggaatcatgtgactcccagggttgggcaggaaattagcttttgtccagaagagcaggatacaacaaaaattattttcttagctccaaaggcctctttgctgcagaagcccaaattgaaagagtggcttagtgattcacttaagtcattagacagcctgctgataagaattagtttagattttgaaaaaaaagggagacttttttttttcagggctaagtataggtctcagttatagagaaaagtaagaggaaaaattgtcatatgcatacagtattacataatattctatgtcataaatcaaattttatgggagtaggcatttgttgcattgtgtcctcatacccaattgtgtgattgtgtgtgtgtgtgcatatatgttcattgaggcaatttgtaatagaaagtttattggattttactttgatttctcctttattaaagtattgaggaaatgacaaaaacaattctttgcttttactttttttttttggcaagctccacttttaaaactgtttatttttacagatgtatttcatcagttcttaagaatgaagctaggaatgtttgctggcttctcagttagtaccacccagaaactgaaaaaaatctgttttcttaaaatatgacattggggggaagtagagaaacttttcatttttgtgacctattggatttaaaaaaatatatttaaataatgcatttttaatattgctgtttaatgtactgcttatcttaattccatattgctttctgactcttggttgttgtacttattattttatagttaataattgtaatggaagggggataaaagttcatgttttattttctctggaaaatttgaataccctgtccatcctagaattgtttcttattcagagagcctcctccaggtaagtctccaagaattttgacacttaataatcaagtgtgactctctgatcagtcaacaagtacacttcttataaggtatgtcttaaaataacaatattaagacattgtttggactcattttctttggaccagactagaataagctgagtgagaaaatgacctggaatggttcattccttcatttcgcaaacatttattacgcttctcagttgtaacaggtgttggcaccgtcctatctcttcagaaactgacagttcagtttgagacaaaaaatgaaagcatttacaattcagtatagagactgttaaaaaaggggttccttttcctgattgcatcccaccatttctggccatcttcactctattcctgccatgttgagctttgaagttgaggaataaagcagaagcaaggatggaaaaaaacttactttgcaatcaataaataaaatttaaatcaaggccggcgcagtggctcacacctgtaatcccagcactgtgggaggctgaggctggcggatcgcttgaggccaggagttcaagaccagcctggccaacatggcgaaaccccgtctctactaaaaatacaaaaattagctgggcatggtggcgggcacttgtaatcccagatattccggaggctgaggcaggagaattgcttgaacctgggaggcaaaggttgcagtgagctgagattgcgcccctgtactccagcctgggtgacaagaatgagactgtgtctcaaaaaaaaaaaaaaaaaaaaaaaaaaattaacagagaaccatggtactacattccttttctcttaaatccttgataaaactaatgtatatcataaagcagagttccccaagttgagaaatagatcccatcctcttttagaaaaataaaatccctggacttccaatgttgactgaaattgcttttattatgttacttacattacttatattgtttattacattacttaatatatacaaacatataatttttgtgcttataactctatacaaataaaactaaaacaataaatataaatagaattacaaaaccattacattcaaatgagcggtgttataattcacttccaatatgttttagtgggatgggtgactctgctttgttgaaatagttgttgatttaggggattatagtagaaagatgttgccacaagtctagttctatggttcatctgtttctgtatttgaattttgataatacatatctaacaaatacctatttgcacaagtattgtaagtacttatgagtattgtttattcaaaacagtattaataattttcagtctctaattggaaattaggctcattaagtctttttttttcagtaaaactctgccagtgaatagtcttggaatagcagattaaagatgtatcacttggtaactctttaaagctccattacttgagagtaaagttagcctgattgacatcttcattaaataggcatctgatgcaattgctgctaggcccaggaatagaaaaaaaatttttttgcatacttatgaccatacttatttccaataaattgatatgagttggtataagcaaagatggcactggtctctttcacctctctgcttatttggaccatagggccttccttctggccgtacagatttccctgaagtcaactgatgtaaactcaattgtacatacaaacgactgcacaaagatctcatgaagtactcagttgcatggggtcatctgaaagacgcagactatctttaaatttctttttatagattatcataaaaattaaaacagaaatattttttaaaacatcaataatttgaagacctttaataatagattcataaatttttgttttagaaatactgttagagtttcctgatggcaaaaaatgaataaatactttgggctccaaaaccaaatttctatgcatttaaacatgcaaatagtttttcaattctaaagccacttaaagtatagcattacagtgatatttaactaatatgaaatatgcattttatgtaagtttgatgtgtgttttattttaagagaaaaacctaactgctgttagttcttgctctgctaatcccatctacttggtatcctgatctacctagtttggtttaaagtatgattgggaagctcagctttggtgtcttttatatccagtcctggctatggttagtgttgtcagttctatgtttgagcatataatttttattttattttactttggaaactatgatgttcaaatcttcatgtattactggttatatttaatttgaatatttcaatattagaagaagtgatttgtttaccaaactctagactcaccagtgtttcaaatatctaaatgatgtctaccatttctttgtctatgtattgcattacagtgcaactttaaggctcattatttcatctttaattgaccagcagggtaagacataatcagtgcttgaaagtgcaaatagagcaaacttgtatgcttcatgatgccaggaactctgctttctttctgtctctctctctctctctttttttctgacttatttctagctaatttatttcgggcaggatttcaaccaggggctgattgtaagctccactcactgcctgccatagtgcttggcacatagtaggtgttcactgtagatgaatgaagggataaacaaatgaagaatgaatgactggtatactagtagtggtgatggcgtggcagtgttagttttttagcagaggcaaattttggattttttttaaaaatctgaagctggagagttttatctcactgatcttcatattgcccaagcttttatttattttgggggatgcaaagtcttttagaaaatttgctaatttcattgactaatacacacagggtgaggatgatctttggaaaatcaagtggatggattgcctttcacattgtagtaaataattgtcatagattacatatcaaattgcacatagaatttctgcttttcaattttaatttgagttcacctgtcatcctgggacctcagctgtaatctccttttccctgcacggctgactgagaatgcatttccttgtgctttactaggactggaaaaacccagttatgatcatcttagtagtggtctgtcttccaggctttattatctgcttcccaactctcagcatcaaaacaggagttaccatatccaatgaatacaaagaaaatggcttaatttctgacacatagcttattgaatgtgacccaggcagcaaggatgtggtacagaggagctaatatgcattcctcattagtcagctcacccatgtggtcagcagattccttttctaaagtagttgtgtaatctgcagcagcacagtagccaaacacagttgataaattacgtttatttcattttgacaaaaagagtaaatatattcttgtacaaaaatattcaaaaagtttaatgtaaagaagtaaatttaaatcacctgtaatctcaccatctagaaatacactcatttaaatagaagctgccactttactttttttttttttttaaatgtcatggctgttttttctccaacttttattttaggttcaggggatacatgtgcagatttgttacatgggtaaattgcatgtcacagttgtttggtgtacacattatttcattactcaactaatgagcctagtacctgatagtttttcgatggtcaccctcctcccaccctccaccctcaagtggtcgctagtgtctgttgttcccttctttgtgtccatgtgtacccagtgtttagctcccatttttaagagagaacattggtatttggttttctgtttctgcattaattcgcttagcataatggcctccagttctatccatgttgctgcaaaggacatgatttcactcttttttgtggctgtgtagtattccatggtgtatatgtaccacattttctttatccattccaccattaatgggcatctagatggattccatgtctttgctcttatgaatagtactgtgataaacatatacgtgcacgtgtctttatggtagaatgatttatattcctttgggtatagacccagtaatgagatttctgggtcaaatagcagttctgttttaagttctttgagaaatctccaaactgctttctaatttattcccaccagcagtgtataagcattcccttttctctgcaacctcgccagcatctgttattttttgactttttaatagtagccattctgactggtatgaggtggtatctcattgtggttttgatatgcatttctctaatgattagtgatgttgagcattttttcatgtgctgttggctctgtgtatgcgttcatttgagaactatctgttgatgtcctttgccccccaccccacaccccctacttttttttgagacaggatatcactctattgcccaggcaggctggagtgcagtggcatgaacgctgctcactatagcctcaacctcccgggcccaagcgatcctcctgcctcagcctcccaagtagctaagaccacaggggcatgccaccacacctggttatttttttatttttatttttttgtagcgacaagatctccctggtcttgaactcctggactcaagcagttctaccacctcagcctcctgaagtgctgggattacaggcatgagcgcccatgcctagccatctttgcccatttttttaatggggttgtttggtttttgcttgttaattcgtttaagttccttatagattctggatattcgagctttgttggatgcataatttgcaaatattttcttccattccataggttgtctgtttactctgctgatagtttattttgctgtgcagaagctccttaatttaattaggtcctacttgtcaatttttgtttttgttgcaattgcttttggagtctttgtcatgaaatctttgccagggcctacgtctagaatctcatttcccaggttttcttctagggtttttatagttatacatttcacgtttaagtctttaatccatcttgtgttgcttttttatatggtgaaaggaaggagtccagtttcaatcttctgcatatggctagccagttatctcagcaccacttatcgaatagggagtccttttcccattgcttgttattgtcaactttgtcaaagatcagatggctgaacatgtgtggctttatttctgggttctctaatctgtttcattggtctatgtgtctgtttttgtaccagtatagcacacttttggttactgtagccttgtagtgtagcttgaagtcaggcagtgtgatgtctctggatttgctttttctgtttttgttttctgcttaggattgctttggctattcaaacattttggttccatatgaattttagaagagttttttctaattctgtgaaaaatgtcattggtagtttgataggaatggcatcaaatctgcaaattgcttaggacagtatggccatcttaacaatattgattcttcctatctgtgagcatggaatgtttttccatttgtttgtatcatatctgatgtttttcagcagtgttttgtaattcttgttgtagagatctttcaccttcctagttagctatattactaggtattttattctttttgtggctactatgaatagaactgcaattttggtttggctctcagcttggatgttactgacacatagaaatgctactgatttttgtatattgattttgtatcctgaaacttcgaagttgtttatcagatctaggaacctttgggcagagactttggggttttctacgtatagaattacattgtctgctaagagagaaagtttgacttcctctcctcctgtttggaatccttttatttctttttcttgcctaattgctctggctaggacttctagtactatgttgaataggaatggtgagagagggcatccttgtcttgtgccagtcttcaaggagaatgcttccagcttttgcctattgagtatgatgttggctgtgggtttgttatagatggctcttattattttgaagtatgttcctttgatgcctggtttgttgagtgtcttggttattttatcaaaagaacttaaaaatacattttatttattacccaagtaatacatgtttacttttagaaaaatcagaagatatagattaaatcaaaagaaaaatacttactatgataccatgataccatcttgtagatagctgctattgtggtttgggcatatattcttccagacttgtaacttcacaataaattgtgtaaatttataacaaggtatataatttcttataaaactggaagcatactatgcatagttaggtgtaatcatttttctgactctctttccatgtcagtaaatatatttccctgtaatcattactaatggctgcaagacattccattgtatttatgtataaaataaataaatgtatttaataaagcttatactgatgaaaattaggtcatttaaaaactgtctttatatggagtttgtgccaaaaaacacaaacattttacatttacatttacatttctgtgagtccaatctgtcagtcttgttatggtttctgcatttgggatcaggctgaggaattcctccctgatacaaatatttttaaattattcagctctgttttcatctgttttaacactaaagactttagccaatgtagaatttttcttatgtgttatgagccaggaatctaactttaattttttctaaaaaactttgttaaataattcatccccctgctaatttaagatgctggttttgtcacaagcaataatccatataaataattaggtctgtccctaaacttttatatttagttctatgatctatttctgtgccagatttatactgttttgattatcgagggtttataatatgcttcagttgatgtctggttgagcaaaacccctctttttctcaaagttttttggcttgtctaacagctgatcatcttccagatatgtctagaataatttgtcaaattatacaaatattttacaacttgacattttattggaattatattaaatatgaagattaatttggggagagtgacatatttataatattgtcccatcaaataatataaaatatatctctattgatgaatcttttttttttaactcctaatcacgtttacatttttttttttttgagacagagtatcgctatgtcacctaggctggaacgcagtggcgcagtctcagctcactgcaacttcagcctcctgagttcaagcgattttcatgcctcagtctcctgagtagctgggactacagacacacaccaccacacctggctaatttttgtattttggtagagatggggttttaccatgttggccaggctagtctcaaactcttggcctcaagtgatccacccgccttggccttccaaagtgctggaattacaagcgtgagctactgcactgaggtctaatcacatttttagcttgtcatatagctactgcacattcttgttaagtttattttacaatatcttattctttgtttctattgtaagtggaagccctttctcacttgctctgatgattactagtgcaaatatatgtgaatctgattatatttgtttcatatcatacttgtaaatcatttatttgttctaatatatttttattttatttccttaggtttcccgtagaaacagtaattccattctttagatctcattttcctttcttgacccattgcatagattcaaacctggtctagaaaagtgctgaaaaactgtggtgatatcagggcttcctttccttattcccaacttcagagaggctttaggtcatcactgtccaatagaactttctgtaattacaggagtattctcccaatgtctaatacttgtggccactgagcacttgaactgtggctgatgatactgaaaaaattaattattttattcaagtaaaataatattattttggacagcacagctctaggttttttgtttgtttgtttgttttgagacagggtcttgctctgtcacccaggctggagttcagtggtgcaatcacagctcactgtggcctctacctcctgggctcaagcgactttcctaccttagcctcccgagtagctaggaccacaggtgcacaccactgtccctggctattttttttttgtatttttttggtatagatggggtttcaccgtgttgcccaggttggtcttgaattcctgagctcaagcgatccccctgcctcggcttcccaaagtactgagattacaggcgtgagcctgtatgtgcctggccagagtttcactattaattatttatttcagatgaatctttaacatgataaagtcagcttggggaaaagatcatgggttaaaaaaaagtaagagtattacgtagataattgtcaaacacatgcctttagcaggatgtgaaagggagtagagaatagcatgataactggagtgagatgagggttgaaaaaagctagttttttgtctgctttgttaagattaagtatggctccacatccaactctttatttatcttccccaaatataccatctcactgtattaccttctggtaatattgctaccattatgctactccaaaaccttgttaccactttttgagttctctttctcccttgtcccctaataatgcaaactctccctcattctacccccattcccacaacctgtatctcacccagttttcaagttccttcacaagtgtaccttctgcatgaaaaaacttgttcttgatctcctcagtgaaaagtagtcttgttcttcattaaaggtagaattaatttgtgtcttttttataccacttagtcctgcacattgtcttcttcctatttgttaacatatctatgagactgtacactctgaggatctcatccttgactccttgactgattgacctttctatccttgttggtccctctgctggtgtgctacatatatattgtatacctgtgcttagtaaatatttcttacatgaatcacaattcaacttgtattaatcatttatgtcttgtattcaattgacagcttctggagaacagggatcatatgtatttatttttgtatcttctgtgttacagcatgatactaaacattgaagagttgtttggtaattattttaaaatttttattcataaaagtcgtgttaagatgttttatttaggattgcattttgcttcatttggtggaaatccaattaaagtaacataaccaaacaggaaggtttttgtgtttttttcctttcaaataacaagaagcctagaggtagtcagtctaggggtggtatagtggtactaggttctcatcagtgtccccagtttttctgtccttaacatgtagcttttgtccttgagatcacatgaggcttttccacctccaggcatccatatttatgttgtttctgtccctttctattaggaaaacagtagcttttctggaggtctctacaaataaacttctgctcttatctctttagtcagaactagggtcaaacgggcatcttccagggagttttgaaaggtattattaactgggtgctttccatccacattaaattgggatttttttttggaaggaagaaagaaaaaataaatcttggatgggaaatctagagtctatatcttggatatggaatttatacttaaagccattaggatctacaagggcatgatatgatacatgtgaagatttcaacaaatcaagacaattttgtaataaattccatatgcacagctggacagtaagtgctatcaaagattagaggtagatgagctccctgaaagatggagttgactagaaaatcttcagtgtaagaggtgggacttgagcagacccttaagagataggtcaaatattatacagaggcattgagtgcttgttttgcaagtgagaagcactttttttttgtttttgaatcattagaccagcttagcaaaaattaatgcactcatattatagggcaatagaaaataagattggaaaataagttgagacaacataatggaggtctttgaatgccaccgtgaagagtttgggtttgaggttgttcaaacaagcaaatctaatgcaggtttctgaaaagaggaataatatgagggagtggaatagaaatgacatatattaaagtttaaaagaatcattcacagattagttcattcgaattaattaatcactaatgttatatctcctaccctgtagttaagttcatagcactttttttgttttgtttttgagacggagtctcgctctgttgcccaggctggagtgcagtgaggcgatctcagctcactgcaacctccacctcctgggttcaagcaattctcctgcctcagtctcccaagtggctgggattacaggtgtgcgccaccacacccagctaatttttatgtgtgtgtgtgtgtgtgtttgtgtatgtgtgtgtgtatatatatgtgtatgtgtgtgtatatagatgtgtgtgtgtgtgtgtgtgtgtgtatatatatatatatatatatatattttttttttttttttagtagagatgggtttttgccatgttgggcaggctggtctccaactcctgacctcaggtgctccactcatctcagcctcccaaagtgcgggattacaggtgcaagccaccatgcctggccaagttcaaaacacttttgagcaaagcagttgattctaaggggtccaatacctaaaacagatatttgatattgttacatttgaggccctgagttatagaatagtgaagctctagaaataaaattttctgttaaacttattttttatattgccaaggaattctttgcttctgttatcattacagcatattttaaatattgtatcagcatattttatcatattaatacccaactgtaatctttcttaattagcttgcactaaatgatttataaaatgattgaaaacacttgtgtgcttttgactaaatgtgttttattgtctgttattttctcaacctagaattttaagtctattgaaaaatacttaaatttcaatgcagttatgttgactgaatgttttattttcctttttaaatcaatcttaatatattttgtagtttcttttaagtgaggtgtgctggagcatttcccagatacaattatgaattttttaaaatgacagatgtttattcaaatgtaaatctcatcaaatagtaaagatttttatcttctattttaataatatcaattacttctgatggtttgacatagtttgagtagagaaacagtctgattcaattgaaacacataaaatatgcttgatataatttcctacataattataaatgaacttctgaagtctgagttacctcatttagtatttggaatatcagaaattttcacttcagaacattaaaattagtgccttgtgtctttagactctcctccttaattaccacaagatcttttctttcagggtcttattaatatgaatttgactctatgtaaaaatgtagatgtagaaataatttattgcagtttctcctaatcagttaaaattttagcattcattgttgggtactttttgattactgttcagccctatcccactgatgttgggtttggccataggatttgctttggtcagtggaatgaatgttagtgatgtgatataaagccttaaatatgcttgcatggtttggcttcagtttttttcactggtcatttgttatgagaagagctttccctgggcagctgctgccccttcaccttgggttccagaattaacacaagtgaatcgaacctgagcccaacctatagcctgaaccaagccacccaaccaaacccagcctagatcagtcaaactgtagtcaacatacagacttgtgagcatgaaaataaatgtttgttattgtaagtcactaaatttggggtgctttattatgtaggattgttgtcgcaatagctgactgatatgaccattactatttcaaaaagcacatctatatattttcattaagaaaaagtaaaattatagatggctaacctatcagttctctattaattgaaaagtagtaacacttaaaacacgaattataaaacaccaattatttgagagtttttcttggctagtggccattacaaattttattgaataaaattctttttttttttttttttttaaacacggtctctctctgttgcccaggctagagtgcaggggcacaatcttggctcaaagtaacctctgcttcccaggttcaagcgattctcctgcctcagcctcctgagtaggtgggattacaggtgtgtgccaccacacctggctaatttttgtatttttagtagagacaaggttttcaccatgttggccaggctggtctcaaactcctgacctcaggtgatccactcgcctcagcctcccacagtgctgggattatagacataagccaccacaccccgccagaataaaattcttgtaatggaacttgaggaataagttgttgaggtacttattattagttttaaaataaacctggctggcactacaagtaatcacaaaatgaaatgacataggaaccatggctggcatttgttaagggcctggccacacaagtgtttggcattcttctcttctcctcacagcaaatctgtcaaatctgtcaggcagtcaacacatatttattgagcccttaccatatgccaggtattgcaaagtatgtattaccctatttttgttgcatgaagaaactgaggctcagaaaagttaaatgactagtttaagcctcacagctaggaaagggcttgagttttaggacttgacccaagtccatctgactccaaaaatcatgctattatcatcactgtgttatttgtgtttgggtggaactaggagaaaaatagaattacaggccaggcgtggtggctcatgcctgtagtcctagcactttgggaggccgaggcaagtggatcacttgcggccagaagttcaagagcagtctggtcaacatagcaaaaccccgtctctactaaaaatacaaaaattagccagttgtggtggcacatgcctgtaaacccagctactcaggaggctgaggcatgagcattgcttcaacccaggaggcggaggttgcagtgagccaagattgggccactgcacaccagcctgggtgacagagcgagactctgtctcaaaaaaaaaaaaaaaaaaaattacaaactgatttacctaacatttgttggtgtgttatctctagtcatttgctacataacccagaggtcacccagaatcactttagcattcagaaatctacatataaattagctcagacccaaattgctgttttttagcatgtgaaagtctgaagctgtccgtacaatttctactaattccccggccttacagtcatgtggtccccttcatatgtccttggaggccaccttgatttgccatgtcagtctgagtgtaaagctcaaccctttccagtttctaccagacataccttcaccaagcattttctgagttttggtgaggacctccatgcaaaacacgagatctccaccattctttccctctcaacgttgccccttgattgcaacaccatgccccttttcatattctttactctctgttttgcagattagcttttcccttctattgaagccttgatagcccagatacccaacaactttggagtcatgcctctaccctcaagctggagtgtcagtgagtgccttctttgactctgtctcattacaaagcaaaaatagtgagattctcttgggaaacagcatcagttggaattagtctcatcagtcagacagcccccatttagctcaattttaatttttaaaatggaatttcattgaattttcaacattgacaattttgttcaactaaccttaaatggtgagaaccgaaagcatctaatataagagctactcttttcttcttagattagaaataagatactttacataactaagaaaaagtctatctttagaattttagttacttcctacctctttccaaaaatgtgacttataaaaactacagaataaatctggatataagctttttctgtagtttttcccagaccacttttcctattagctattcagagtgaattttaggagcttgaaaacttgatatgtttatgagcccagaatttagacactgctataaatttaaattgtctgaagcacttgattctacaacactgtgttggaaatggttgaagaactgatttccacttctggataagccaaactactctcttatcttgcaaatttgccactaaaatcttaattcctgtcagaattattttcagtgggagaaatctgagtacaaattgaccaaaagaactttagttctcactcatttctaatataattttaattagttcatctttaatttaggaaataatttttctagcaacttggcagacattggtttcttgccagatactaccttatcttgagcttgtgggaaactcatctttaatattccatgagtatagtaaaactgtgtttttaacgtaacaaatattgttttatttattaaataaaacatttatttgggggtatattcttacctaattaaagagaatgagtaaaagatgaggcagaccctgaatgtgagatgcgtttgaaaatggggtgtctcaagattctgtaccgggacattggggttaggcttctaaatactgttagtccagtcttattactaagattgcataaagagcattttatttttgtgtgacctagatcaaattattttgatgtaggatttttcttctcagtcactttccaagtccccagccagcaatgccccacccaggcctcattcagccacactggcatgccccagttttcctgtggtatagcttgtacctgtgttcagcagttcccgaactcttgtcctgcacccaagaagaatgaggatgtgctaaacattgaagggtgaggaaggtggagaagaattttatagagctatgaaacagttttcagcagagaaaggatgcgggggttgtccccctacccaaaggtgggaatgtcccctgtgcagccaggcatggggccttctatggactcagaatggggagtgcgtgctgattggtttgtgtgtatgcaaaaaaggttaaagcaaagacaccactcaaaggtgggcatgacagtgtagaaaaccaattagaaaagggtaggtatatgtaaaataggtgaagggtggggatcaatcaaaggaaagcatgccaaacaggaagacaagttcttaatccagtctgaggatttaacttgtagcttggctttcaggctttaaactttcttcgccttggaggtggggtttcaccgggtaccagcccgtctgcctaggcatttggctgcctcctttctgtatcaatttgaccttcctaaacttcttattcgttatcttttaaataagtattatgtctgccctccctaccttaaaacgttgtaaggtttagatgaaagaaatatacatgaaagtactttgtaacgtacagtacctacagacattagtgattatgtttgtggggcaaaaaaagtaggcaggatggaagaaaggaaagcaaggttgctcttaaattcattccagcagtatggctggaaatgaataatcttcaaatcctgagcagttgcaagataaggaaaggattaccattctgggggcacagcaatgacagggccctttaactggccacagtgattgccagttccaaccatttcaggtaatattgtctacagtgtgctgagtgccatgttagttactagggatacacaccatgacaagaaacagtccttcgccctcaagaaattctctatctggctgtggacaacacggctgtgtgtctctagcaggggtgagccaggatatggcaggctgggtggagcatggttggagcagaaaaggagctggttattgtgacagggtctggcatgttttttccatcattaaatggagtgatttaaaaataatacaccatatttatatttttaagtcacagagaaaaacaagggtgttttaaaatttggttaattacaaaatcctgtaataacactttttttttcttttaatacatggggagtgacagcatcagcatgatcttctttacagttttgtcatgttttaggattttactatgctcattttaagtttcagggacattattgtcacgatgaagttctactctgttgcttgttggtgttctagtggtgcaacactaactctttggatgtcatttttaacttcgtcttttgtattcaaaagttgaattgctagtgatctttattttggtagtttttaaaggaaataagtgtataatatattatccatactaaatgagaggacccactgacaaggattacttccaattaatggtaatcattttggggtctggaataccttaagtattttttttttacttgtttcttagacaaataataaaataagcttttactttctgaatatacaacaacagggatggagtgaggggagacattccagaagatgccaatagtataagttgctaacctaggattaataactcattgcagaaaattcaggagatgacggtctagtctggtactgaattaaattatctacggtatttaatgttttactctagtagatttgctggtttggtgtctaccttaacttaaatatttagagaaaaatatggaaaagtttgtgagaaaatgaagtcttgtataaacatccttgtcctaattgttcacctttactgcagaaatcccagactggcaccagtgtggccgaagttcacactgtgttactataaatttacatgatgtagtggatgtcttaagaggtggaggcaatcccatattcaaaattgaaaacaaaaaaaatatttaaatacccaagtgagtaaaaatggactctcctggataagtctggaccatctttcaaagatattgagcgtctggaatttttatgtgcatttcgaggctgcagtttcctctgacagacaatccattgttattactggctgtaggcagtcctgaaagggcagagtcaggaaagacaaagaatttacagtacagaactttcaataatgtgttgatgtcaggaaaagagttgagccatttctgataagaaagaagtgttaatgttaagcagctgtaaatgtactttctgtgatctactcctgcaaagtaacagcagggtatttcttaggcttgggtcacaggatgaatttgagtaatcaatccttaagtgaaagcaaagagagaatactggaagatgtgacagaggtcagccctgggaatggaacatgtagtcttttccaatttgatgttcttgtcccaggtttagatttggcagcagctacctccctcctttaagtcctcaccaccattcccttacaacaaatcaacatttatcagtaactgtgaaagcacagtatcaaaattatttctaaattagagtttgagaaatgattttgaaatttatatagcattcctagtactcaggccaactcttcatagcaacacactcattttgattcttaaagaaatgtgatatattttttcctaaatagatttaaaattttaatcaacacatttggcttatatgatgaaaaactgcctgaggctatggaattgggtaagaacttgttattttggtgaaggtgcatatattctgaagacgtatctgcaagccattgggtacaaatactgaatgtgagtaaaatttggaagttgactgcttcagggttccaaattgggccatcaatattaggatatatataattttaaatccagtcttaaacctgtgtatgttcagaaaatcttttgtcaaagagtgagtaataagtttctatttttccaaaagcagtttaactaagtattaggtgttcagggaccagattcttattcgagtcttatttttaagagtttgaagtcaataacttattttctttgtccctcatctcttttattccacttataaagtatgcacactgggctgaacaaagtggctctcgcctgtatcccagcactttgggaggtcaatgtgggcagatcacgaggtcaggagatcgagaccatcctgaccaacatggtgaaagcccgtctctactaaaatacaaaaaattatccggttcatggtggcgcgtgcctgtagtcccagctacttgggaggctgaggcagaggaatcgcttgaacctggaaggccgagactgcgccactgcactccaccctggcaacagagcaagactccatttcaaaaaaaaaaaaaatatgcacactaattctggctctcctgcttttgaaggtatcacacatataatactctttgtgataaagccttaaattatcagagtggtaatactttaaggctttattaatccaaagtaagttgtgatattttaaggctttatcaatccaaagtattgttacagatatgaatagtggtacctacattgcatagaataggaactgaatcatgtaaatcaatgctacatcatttgaagtcttgcaggaatggacaagaccagtactcaaagctaacaatattttggcctgattttacataactttcaaatcatcttctcagaaagctaaaccccagctgctcttcaagataagccatgatgacagagtagctataaaagtagtgtctcatagataaagagaagtatgaacaggttcaggctggctgaataatagcccttttctctttgaaaggaaatggaaggaatgtagctgtatttgcaggtaatgaatttcaatcccttattactttctttgggacacatttactacacactgcattaggaaggaggaatttacatttaagtatggaagtggatcagaaattagtagatatataagatcaggcagatctttatcattgagcaaaggtctaaagatagtagtgcagtctgtaattctgtaagtggatatattggaaccataacaacagcaacagctaacatttattaagtgctcattatttattagatacagtattatgtatcatctgttattcatgtgtaaggcaggtagtgtctttattcccattttggagatgaagaaatcaaggtatacagtagttaagaaacttacttaaggtcatacgatctgtgctagctttcagattcagggaacttgacttcagaaaccatactcttaaccagtatgccaaaccaccttctatgaatttgaaaccacctcccatgaattgatgaattcataattcatcagttggtgttaatggaagtggtggaatatagccctgaggccaagttctaaattgtttaggaagtgacccaaatactgagataatcataacaaaaaaagaggagagaaaagaaaaaaaaggaaggaagggagggagggagagaaagaaaaagtccattccaacaggcactgggtattggatattatgggagtctcccataaagtataaggggcccataaccaggggactgagacttcacagtaaggaacccagccagtagaaactgggatacagggcaaggaaactttccagtaacagtggactggaataaaatcagagcaaaatcagagataaaataattcaaagtagaggcagcatttcttgacaaaagatttcttatgttatctcccctactgagggctgaagttggccccagagtgagatgcatagttataagtcagggttaatgtaatagattcagctcagaggcaaacagaagcaagggcaccgagccaggtaggccattacaaaatggcccaactgggttagagttccaggcaagagacttattttcctaactttactaacattatttctccattgtggcagctcccgcttctgtgggacatggcatcatgtagcagtgacattagatacccaaagactgtggaacagggagatgaagtttcataacataattacaaaatttaacagcaccctttcacatattttatggcccaatctatgttgttattcttttattattttttaagaaatgtagtatgttatgtaatatactgattgcagagttcacgaagccatttgggagattactgggaggaataatttgatatgaaattattatttaattatatcactttcttattctgtcttatactaacttttgcagaatgtatattatttggagagccttgtttgatatccttaacagacagagtaaacattcaagatagtacttttaggagagtagtttgaatagttttcatttgctaattccatcctcttttttctgtgaaagagaaaaacaaaaacattttattttgttttctttcatgtagtgtttatccattgcctccatattttataacagcaccaaagactagtttttctgttctgtttaaagctcatagtttcttagaactagttgtaaatactgttaagagtcccccaaacagttttttaagaacctaatttagtttcatttgtactaagaagctgttttctagatgactaacatcatatagtgttgtttccatcaaaaatattagtctggcatttgtcatgttctgtccactaaatagctttgttattattgaggtctaagctctgattttttatcttatccaaattcctaccttaggggtctagggagtcatgtcctacaaaccataaattctcatgagatgggttttatttgaccctatatattgtgacttacttttcagtctgactctggcataacattatgagacaaggaaaaaatatttaaccccaaaatatatttccttgttataccttgaaattgccctgcaaagtttcttgtgggaaaaatccacattctatagagaatccccttccccttttgttttccttcctttctttccagatacaggagttaatcaactaagaggtaggcacccttttaagtcccaaaagaaacaatttacaacccccgctctctctgaagtctgctatctgagagcttcctctgcacaataaaagttggtctccacaatcctttaccttttttttgtttcgttttttgtttttttgagacggagttttgctcttgttgcccaagctggagtccaatggcgtgatctcgactcaccacagcctccgcctcttgggttcaagcaattctcctgcctcagccgcccgagtagctgggcgccaccacacccggctatgcgcctggccacacccggctaattttgtatttttagtagagacggggtttctccatgttggtcaggctggtcttgaacttccaacctcaggtgatttgcccacctcggcctcccaaagtgctgggattacaggcatgagccactgtgcctgcctcaatcctttatctttaacctgaacattcctttctgtcgatccaagtctttagacaaactccaccaattgtcaaccagaagatgttggaatttatttaaagcctggaagccccgctttgagttgtcccacctttctaaatcaaaccaatgtatttctttcttttcttttttttttttttttttgagtcaaagtcttgctcttgtcccccaggctggagtgcaatggcacaatctcggctcactgcaacctctgcctcccggattcaagcgattctcttgcctcagcctcccgagtagctgggattacaggcgcctgccaccacgcccagctaatttttgtatttttagtagagacggggtttcaccatgttgaccaggctggtcttaaactcctgacctcaggtgatctgcctgcctcggcctcccaaagtgctgggattacaaatgtggagccaccgcgcccggccaaaccaatgtgtttcttaaatgtatttgattaatgtctcatgccttcctaaaatacatgacaacaagctgtaccctgaccaccttgggcacacgttctcaggacctcctgagagctgtgtcacaggctgtggtcactcatatttggctcagaataaatctcttaaaatattttacagagtttgactcttttcgtcaatattatgaaatgtgtctgagatacatatacaaaagaaaaatactaagatatagcatgcatccaagaaatgcagtatctttctgttaacataaattatctaaattcatataattcatgtgcatttctgagtctcatctcacatcagacaggcagcctgagatgaagaatgagcacgggctcaggttgggacctggtaaaagcaggcatcaccatttaaggagcagagacctctgctaggttgtttcacctctctgagtttgtttcctcatgtatcagttgggaatgatatcgaatttgtatcatccttatgaaaaaacaaatatatatgaagttgcaaatataggttttcaacaaaagttaacagctatcactcattggcatctagactttaagatgattccactcaagagagcgacataattctaaataagaaaatgcttttgatgtaagagtccatttcctgcctctcgggcacgccaccacagcctgaggctccattagctgttgctatctgcagttagtgatttagcttggagcatatcgggcgctgtactaagtgatctacatatgttatttcatttaataacagcaatcctttcaggaaattttggtttctgactttctaccatgactttgacctatgtacattttcttttagactatgtattcttttgacttttgtctgccttattctagccattgctttgcacaaattatggcactttatgtcatcaaaccatattagttaggaggctgtgggatgcaaataacagagaaccagacttgatctgtcaaaaaataaagggaatttttttcatatacacaactggataattcttcaccgggttctatctctgtgattcttttcactctgtcttcctccatggctctgcttgttgtatcagaaatggctgcagcagttcctgacatgacatctttgtactacactctccagaggaatggagagttgctgttttcccagaaagaagctcttggcttccttcgacaggaccagtgtaggtcttgtgctacctctgacaccatcacttagaccaggggcttggggtcattgactggcttatccctgctcttccctgagtcaatcaacggacaagaggaatggtgttacattgcttagtttagacctacacccgaggttgtggtccatgtcacccaaatcgcatgggcatcatggagcaggaggtgaaatgggtacaggaaggccgtcttgcccccagtgtcaaaggaaatgggtattagtccattttcacactgttataaagagctgcttgagactgggtaatttataaattaaagaggtttaattgactcacagttctgcatggctggggaggcctcaggaaacgtacaatcatggcagaaggcaaagggaaagcaaggcatgtcttacatggcggcaagagagggagagcaaagggggaagtgccacacttttaaaccatcagatctcatgagaactcatttactatcacaggaacagcaagggggaaatccgcccccaagatgcagtcacctcccaccaggcccctcccttgacatatagggattacaattcgagatgagatttgggtggggacacacagccaagccctatcagaatggttacaacatttcacttttaattatgacatgttgctagagggtttcttttaaaatttttttatcagtttaaggaagtcatcttcacaattaagtttttttttttaatcatgaatggaagttgactttcatcaaatgttttttctaaatctgttgagatgatcatgtggatttttttctttattctattaatgtgataagttacactcatttttaaaaacaactttagctataatggcatataataaactgcacatatttaaagtatatagtttgatagcttttgacatatgtgtatacctgtgaaactatcaccataatcaaaataatgaacatatgtatcattcccttccaaactttttttttttttttttttgagacagggtctcacactgtggcccaagctggagtgcagtggctcactgcaacctctacttccctgggctcatgtgattctccagctttagcctcctatgtagctgggactacaggcatgagccaccacacctggctaacctggctaatttttgcattttttgtagaaatggggtttcaccatttcctcaggttggtcttgaactcctgagctcaaagtgatctgcccaccttggcctcccaaagtgctgggattacaggtgtgagccaacatgcctggccccaaacattttcttatccctcctgtaatccctgtctccagccccttccctcctacccctgctccacacctgatctactttctgtcactacagattagttgcattactaattgaagttttgaaggttaaattaactttccatttctgaaataaaccagtttgatcattatgtattagctctctctcttacattaagggaacttcaaaaaggtcacgggaaaatggaattaaaagataaaaagaaaaaatataaactttatttttcaacataagctctgtcaagtttaagacacttttataagtgacaatgtcagccatttagtccatccctaaagaactgagggtcctgggatttaaccatgtcagtgcagtctttttcacattagtaactgaagaaaagtgggtgccctttaatgatttattaagattagggaacaaaaagaagtcagaaggagccaaatcaggtctgtaggtggttgcctaatgattttcccgttgaaactctggcaaaattgtccttgtttgatgataggaataagaggagtattgtcatggtggagaaggaccccctgttgaagctttcctgggcatttttgtgctaagcttttggctttctcaaaacactctcattgtaaacggattttatcattctttggctctccagaaagtcaacaagcaaaatgctttgagcattctcaaaaactgttgccatgacctttgctcatcactaatccacttttgctttgatgggccacctctacatcttggtagccattgctttgattgtgctttgtcttcatgatcatactggtaaagccatgattcatctctttacaattctttgaagaaatgctttgggatcttgatcccacttgtttgcaacatccattgaatgctctgcttttgtctgcagctgatacgaagtgcaatggttttggcacctaccaagtggaaaatttgctcaactttaatttttcagtcagaattgtgtaagctgaaccaattgagatgtctgtggtgttggctgttattttttcggttaatcattggccctcttcaattaaggcatgaacaagattaattttttccttaaaaattgatgcagatggtctgcccactgtgggcttcatcttcaacattgtctcatcccttcttaaaatgagttatccatttgtacactactgatttctttgggggattgaccccacaaagtttttgtaaagcatcagggtttagccattcttccacccaagcttcaccataaatttaatgttcttgtttcaattttagcagaattcatgttcctctgatggggctcttttcaaactgatgtcttatccttcttagtgcctcaaactagatcctgttcagacattttatgacaagttagcataagtttattctgatgcaaaaaacccctgaaatctatgcataggtttttcaaaatacacattttccataaactttttgaagacccctattatttctgtatttgtttaaccaacattttgcttctatgtttataaatgagattggggtgtaagttttctttctagtaatgcccttctcatactttagtatcaaggttatgctagccttgtaagatgagctgaggatggggagaatgtttcctattctctgttttattctctggaagaatttatataagacaggtttttttttttaattaagttttggtttgaatcaaccagtgaaacctcctagactcacaagttttttttgttctgttttgttttgttttgagatggagtctcgctctgtcacccaggctggagtccagtggcgcaatctcggctcactgcaagctccgcctcccgggttcacaccattctcctgcctcagcctccagagtagctgggactataggcgcccaccaccatgcctggctaaatttttttgtatttttagtagaggcagggtttcaccatgttagccaggatggtctcgatctcctaacctcgtgatctgcctgccttggcctcccaaagtactgggattacaggcgtgagccaccgcgcctggccaacctatagggttttttttggaaagctttaagttattaattcaattttaaaataaataaggggttgttcacagttttcttcttgtgctgttagtttttataaaaggtatgttttcttgactttttaattgactgtatgcacgtaatatgcatgcagcatgagcaatgagagtgagaccctgtctcaaaaccaaccaaccaacaacaacaataaaactctataagctctgtagtgacgtttcctcttttatttctgatattggttatttaagcttgctttctgtatttcttcattattctccatgggggtttataaatttattcatcatttgaaagaaccaacttttacccttattgatcttctctattgtatttttgttttctgttttacttgttgctgttatctttttatttccttccttatattttctttagatttctggaattttttttgtttgttttttgttttttgagacagggtctcaccatgttgcccaggctggtctccaactcctgggctcaagtgatcctccttccttggcctcccaaagtgctgggattactaaataggtgtgagccactgtgcccagcctattttatttagatttaagttgttcttttcataactttttatcaaggatgtttagcttattgcttttcagcttttcttcttctctaatatatgaatttgggggccataaactttactcgtagaatagttttaatggtgcacctcataaattttaaagaacatttacttcaaaatgggctctaatttccactgtgacttttttctttggcctatgggttattagaaagtatatttcttaatttataagcattgtgaattttctaggtaaatttttgttattgatttctagtctaatttctttatggtaaaataatttgttttgtataaattcaattctttggaatttgtggcaatttgctttcacatatgattttgataatgatctatgcatatttgaagccaatgtgtatattctgatgtttcaaggtagagtattgtatttgtgactattaggtcaaatacgtaaaaagtattgttcaaattttacatatcgttataaattatctgatatacctgagagaggtatgttcagatttctcactatgatttttaaatttctctgttttgtcaatgttgtttaatatataattttgagctatgttactaggtgaattaaaatgtagaagtattatctcttaatagagaagttaaagttttatcattttgaaatgcagttgtccctccatatccataggttccatatctgtggattcaattggggatcaaaaatatttgggaaaaaattgcatctgtactgaacacatacagactttttgtcttgtcattattccctaaacaatacagtatgacaactatttatatagcatgtatattgtattaggtattataagtaatctagagatgatttaaaacacatgggaatacattatatgcaaatactattctgtcttatgtcagggacttgactatccatggattttggtatccataggaggtcttggaatcaatcccacatggatacctgaaggccttctttgtctgatataaatatagcttatatgctattggcacatgttttcattttatatatacttaaaatctcctaatgtattattataactattgctatatttggttaaaaatttaggtttatccacgtttgcccttttcattgttctttatgccttcctgcatctttgagcttccatctgggagcggaatacacccttcagtgttgtctttaggttagactatcgatacaaattctctacatgaagtgaaaaatgttttttttctctacttcattattgaggagtaattttactggtagagaattttaggtttatagctatattccttcggcactttgaagataattccattttattctggcttctcttgattctttcaagaagtcagctgtcagtctgatacttgcacctttgatgttaatctgtcttttctctcaggtttcttttaatatgtcttctataacttttatttttagcattttttactatgttgtgcttttctttttccttatcttggtttaagtttggagatctacttgaatctgtgcttttggccaatttttgcaaagtctcagtcattatcttcttgaatatgcctctttcccattctctcttccctctcttctggataccttctatctatctaactttctggacatgcatgaatgggccccggcaacctatctgaccccatcccctgccgtactctcgttactcgcttgtctctatcttgctgtttttctaacatgccaagcatgcttcttactcctagatttttaaaaatattgcttccttagcctggaacactgttttcaagatatgtctaagactcattcccttacatgattcaggtctctgctcaaatgtggccttatcagagaggctttctctgacatttattcaaaattatcatccagacctctcctctcccatattgttctctaactctttacctggttttatgcttcttcatagcacttactacaatatgacacattatatatccaatatttatttgcttattctttgtctctctccatttgaatagaaattctgaagttctgtaagaggagagagctttttcccaccccctcctcacagttgtatcccatcccctggaatagtgcctggattagagtaaatgttcaataaatatttgtaggagaatgaatgaatgattaatagatagaagatataggaagagttctctacaggaagtaaagaaagtggagaaggcagaataacaaactaagtaagtcttttaatttgtatggtctatattttaatctttcgaatgtaaagatagtatcattgatcatatttctgttcatcaatgttacctaaaatagcaaaatgaaatattaatatgtttgaagatatagctttcattagtttaaattaactatctcatttagtttaggcatatggtccacaaatttttaagaacatttaattttaatttaaaaaattaagcctaccaaataagatgcattattttccagtgacttaatatgtatattcaagactttttcaattttttatagtataaaattattgtgattgcacatgaaaatttattatttaagcaaaatattatgagtgcttataagtacaaaggctaaaactgatatccctaccaaccacaaaaaaataggccaggcagctgggtactgcctagcctatttttttgtggttggcagagatatctctttattgtgtagatatttaaggactcatatagacccatcattttttatgggcaaaaatcccaactctggtcttctaaatgtcttttgtaaatttatttccctaaataaatcataaatccacttataatacctagacccacacaatgtgtattcgtcatagctgctcaaaaggaatccacagtgtaggtcagagctacttgatgagagaaagtcttgactctgctaataatgtttttacctcactggcacccacagtattttgccagattgcctgaagtcagcatgccttcctgatggtcatggactgttctgcttttccaggaatgtctcaaagggatcctgcctgaaaggaaagaggccatactgtgatatttcactgcttataaagagaccaagaatggcctctgtcttgttcttttagctagcttcaaacaaacttagccagcttaaaaacagaaatggaactgatgaagtcatcaacctagagcctcccgctactgcccatgtattttgtagtctagaatgaagctaataatctcaagaactgcttcctagaaaggttaaggagaaaagcatgccccatcccacttctcctcccatttcccactcttgaaatagcattgttagcatctgatgtgagccagaggagtatttgaggctgtgccatatgtccttgttagaaacactgagcttataatgactaagaaactccagggggttgtctaaaccaccaaggttataaagggcacagcatcatcacagctgaactaaaatttaatatgattcttactttaccacccatggtgacctaagaaggtggtaagggggacaaactctaaatagagggctcagttgtggctcaccaagaagctaaatatgctgttttcatggtagaatagggaagaagaaactggtaaatatttccaaatgtcatgtgtttacatatgaatctattcacttctttatttttaaaattcttctgagaagtactttagaagtaatccctaaatttaaagtatttataacaaaaattttacatattctcaccagtttagagcattacccagaaggaattgtgactccatggtccaggggattagagttagtcattaggggtgggaatttcttctcagaacgaagttagagctctgtaaccatcttatgtgaccaagtagatgtttgagaaagatctggaattaacgtaatgaaggtgagtagcactgagaatgcccatagagtctgtagcttagatgggggtgggtgtcaccatgatcttagtgttgcactttttggaaactaggtttaggtgaggaatgaagtcacaatcccctaagaagggaataatgaataaactagttatatcagcttattactttagagtagaaaacagacctcatgcaggaatcattctgcatatgtggtgaagccttcttggtgagcagacaaacaaaaaagaaaattcactttttctaaaaaaatagcacatcagacctttgtagcctggagaactcattcttctctactttagaggtgtttctttttctaataactgggaagggctgtctctaaccggagctcctgtaccacccctaaagatatcaataatttctcattctccaacttttagttttcccatttttattggtcctcaaaactttgtctttgcggcactccctgcctcatcatacttgtgacaagttgaattcctaagactcaggctcgtattacaaaggatgcaatttagatgagcaactccctggtgagatgagtggctctctggcaaacggggtggggaacatagagaactaagagtcaggaaacttggggcctatatctagggcatctgttacctaacattctgacccagactatgttttccttgcttcagtggcttaggctgcaaaataaggtccctttcacctttgacacataatccagatcttgtactttactttagtaattttagaaagaagacatttaggccgaggagatgaatgtctgttctcattgaggtaatgaggttttctaccactttatttttcttggtaaagtctttgcttataatctggcagcctttatttgtattcctttttcttcctttggctggctggagagcaagtgccattgacatggcccaaagagtatcatcttttcagccttggagcaaggagtctcagagtagagcacccccactccctccccaaatgcctgtgaatgacaaggcaggaaaaacattttttaattaagtcaattcagttgttacaagttgaattaatctctaatttagggatatcatgggaaactatttataatatatgccagctgacccttatccaaatttccatggaaatagcaatgttataacacagggtgttcttggactgctctaaaaattccagctggtttaagtatgatattgaaccgaaaaatgaagccttctactaacaaatgtgttgaagtatgcactcaggtgctcaggaggtataggcttagcttgaaaaaattcaaggcatgataccctgggctttccctcaaacctctttaattaagacctctgatattgttgtgttgtttctatctgaagtcaaatgggaattgcagaaagttttgcagttttttttttctcctccatgaggtagagattcgtctatgccaggagaagtgaagatagtcacgtctttctcttgaatgatgtaataaagttttgcaagggataaaccatgtttcacttgtatcagatttatttatcaaatgtgttgccattaagagtatgaaaatatttcagctgaggccaggcgcagtggctcacgcctgtaatcccagcactttgggaggccaaggcaggtggatcacctgaggtcaggagttcaggaccagcctggccaacgtggtgaaaccctgcctctactaaaaatacaaaaattagctgggcgtggtggcaggcacctataatcccatctactccagaggctaaggcagggagaattacttgaacccaggaggcagaggttgcagtgagccaagatcacgccattgcactccagcctaggtgacacagcaagacactgtatcaaaaaagaaaaaaattcagctgaaataatagcatatgggagaaattagccatgtatttataatacgcgtagtaaaagtgcagacgctatgactatattgcatgcttggtgaaagtaatggcaggtttgctatgttcaaaacatttgaattaatctgttcaaaccatgcacagcattacagaattgacattccagcacagtgactgcagtctgcagcagttgcagttttgtcatctatacaacgtcaaacaagatgcaaaccaccaggcttggtagatagaataccctttgagaattaagtaatcctgagatgactttgctcatcattgatgtcctgtgacgtcaactgaaggcttgtcttgcccatttcaccttgtcattgtggttattggttttctccattaaaatggaaaattggattatatttagcagaatgaacatatatttgatgctttaggtaaaatatatacagtcatatgccacataatgacttgatgttttaggtaaaatatatacagtcatatgccacataattcaacattttgatcaacgatgaactgcatatataacagtggtcccacaagattaaaattaatatttttactataccttttttatgtttagatacacaaatgtcattgtgttacagttgcctacactattcagtaacatggcatactatacactccattgcactccatgtgcgccattgcactccagtctaggcgacagcctaggtttgtagcctaggagcaaataggttataccacatatcctaggtgggtagtaagctataccatctagattcatgtaagcacagtctatgatgttcacacaacagtgtaatcacctaacgatgcatttctcagaatgtatcccagtcattaaatgatgcatgaccgtatgtattatctgaagttagcaccctttagcaaactcctgaatcattaatttgcaaccctttggttacatcttttttcttaccattataagaatttgcttaatatgaatttgtggattaaagtgatttaaagtgctctctatatcagggagattagccctttgtctgtgatatgagatgacaatattttttcccaagtttgacatttttcgtttgaaaaattttttttgtcatgtagattgaaaatttttttccagtacaataacgcgtttaacactggggatacattctgagaaatgcatcattaggcaatttctttgttgtgcaaatattgtagggtagacttacacaaacctagatggtagagcctactacacacctaggatgtgtggtatagcctattgctcctattttacagacctatatggcacgttattgtacttaatactgtaagcaatggcaacacaatggtaagtatttgtgtacctaaacatagaaaaggcacagtgaaaatatggtattataatcctatgggaccattgtcatacatagtccatcttatttatttatttatttgttcattcattcatttattttttgagatggagtctcgctctgtcgcccaggctggagtgtagtggcgcaatctcagctcattgcggcctctgcctcccaggttcaagtgattctcctgcctcagcctcctgagtaatccccacaatctcagctcactgcaacctctgcctccctggttcaagcgattctcctgccttagcttcccaagtacctgggattacagatgcatgccaccacggctggttaatttttgtatcttttttttagtagagatggggttttaccatgttggccaggcttgtctcgaactcctggcctcaagtgatctgcctgccttggccttccaaagtgctggaattactggcaggcccatagtccatcactgatggaaacactgttatgctgtgtgtgtgactatagttgttgctgttttttttttttaatccacagctgacctgaaagtcttttatgtctccagattttaacagaaagccttccccactctgagttagtagagatagtttcctttgttttcttctagtattttaattatttcatttttaaaatttaaatctttactcctttagaatttacctggtatatagtatgaggcatgaattcaacttaattttattaaaaacacctctccagttttctcaagacaattggagttgttcgtcttttcctcactgatttaacttatgtatttatgtatttatttatttatttagagatggggcctcactctgtcacccaggctggagtgcagtggtgcaatctcagttcactgcaacctccgcctcctgggttcaagcaattcttgcgccttagcctccccagtagctgggcttacaggtgtgcaccaccacacccggctaatttttatatttttagtagagatggagtttcaccatgttggccaggcttgtctcgaactcctgacctcaagtgatctgcctgcctcagcctcccaaagtgctgggattacagcactcccaaagtgctgggattacagtggcatgagccactgtgcctggcttagataccctgtgtatcatacaccaaattctgtatgcattgagatctatttctgaatttcctgttctgttttcttgatttgtctattcctgtgtcaggaatacaccttcaactattgtagctttatattattttataataaatgctaggaattgtccccctcattttattctcttttagagatttctttgaaatccttgttttatttttttctgtataattttcatttttgaattgacacataataattgtacatattaatggagtacatagtgatgtttcaatatatacaatgcttagtgatcagatcaggataatcagcatatccataatctcaaacatttataatttctttgtattggaaaaattcaataccctctcttctagctatttgaaaatatgtaatattgttaactatagtcaccctatagtgctataaaacagaacttattcttcctgtacagctgtaattttgtgtcctttaacgtatctcaccatcttccccttcccccatctccctatcctctagtaacttcttttctactttttacttctaagagattggctttttttttagctcgtgcatatgaatgagaatatgaggtgtttaactttctgttcctggctattttcacttaacataatgttcttcagtcccatccatgttgcaggaatcacaggatttcattcttttttatggctgaattgtgttccattgggtatatataccacatttccttgattcatttatctattgttggacatttaagttgattccttatcttagctactttgaatggtgcagcaataaacatgggggtgcagatacctcttcaatgtactgatttcctttcctttggataaatgctgagtagtgggattgttggttcatatggcagttccatttgcagttttttgaggaatattgttctccatagtggttttgttggtttacattcccaccaacagtgtgtaagtgtttccttttctctgcatcgttgttttttgtctttttgataatagctatcctaactggggtaagatgatatctcactgtggttttgattggcatttccttcatgactagtgatgttgagcttttttttccatgtatttttttggataaatgtatgtctcttttgagaaatgtctattcagatcatttgcccattttttaatcagatttttttttttttgctgttgcgatgtttgatttccttgtatattctggatattaatcccctagtggatgaatagtttgcacatattttctccattctacaggttgccttttcactctgttgtttcttttgatgtgcggaagcttttcagttggatataatctgttcatttttgcttttgttgcctgtgcttttgaggtcttattcataaaatcttgccccagaccaatgtcctggaacttttctcctatgtttttctctaggagttttatagttttaggtattacatttaggtctttaatccacttgaagttgatttttatgtagagtgagagatggaggtctagtttcattcttctgcatgtggctatttagttttcccagcaccatttattgaaaagattgttctttcccccaattaacgttcttggcatctttgtcaaaaatgggttgcctgtagataaatggattaatttctgggttctctattctgttctactgatctgtgtgttattttttaatgtatactttagaatttgtttgtctcattctcccccgacccctacccttctccaatttttggccttgttactgtagttataattaattgctaaattagcttagggagaacaactttatgaggttgagtcttcctatctaactaacttggtatgtcttcccctttgtacaagtctttgtgtcttcaggaatgccttaaaattttattagtaaatatggcacatttctaaagctttttcttaagtatttcatctttttctgttgctattgtagatagtcttcccccatttcatcttccaactttctgtgtttgtaatctaaaatctattgatataataattctctatcgtgctgcctaagttttcttgtttactttttcaattgaatgtcatagggttttctatattcatcagaaattgtagtagttttattatgttctctaaatttttatacctctagtttctttctcttagtaattgtattgtctaatatctaatatctaggatgttaagtaatggtggtgacaaatgagcatccttctttgttcctgaattgagtgggaatacctctagtgttgtcctgctaggcataatagttactttgggatcaaggtatattttatcaagttaagaaggtatccacttatttctaccattgatttcaacatatttctaaatcatagtaaagccccagggctatgtacctgcaccatgataggataaaagctctaaaaggaaagacacttaagaccctctagtctaccttcctcccatcatgagtattaaattccaagcacaggaaggttgtaactattccctgccccaaagtcctaaaattagattagaagacaatttggaacactgtctcttaggtcttatagcagcgttttttggggtatgttaggctaacactatttctctataacattatttctcttcctttgtgctctctccttgagatttttccattttatccttctcttctcatctcacttctgggacttcacgtgtattgcttggctgtgcattcttcctccagcctgccattgctgacaagccaagtttatcttaggagagttctagacagtgacataatcccttccccacccaaaaagactctttgctatttgctcttcctggacaaagtacattgtcttccaaatgctgttggttacatctggaattaaagcagaaagctcattggagctgctgaacacctcaaaatatacttcagtttttacagtgcctttagcaaggtgattttagccaacagtgaaagtatcataggcactactgtatcttatattcatttgtaggtggtattcagatttcaaaagaaattgtcataatatttattatatttaaatggaaaacataaacaattacatattagtgctatacttctgattttagattcacctgtgtcataactttaacatcaaaattagtaaatgtttcatatgctaagaaaacttatatgcaaatggaaaaaatctaagccaattattattttcataatgttctactgtgaaacaaaagatagtatttctgtccatatgtagttatcagactctggagtcagatagacttgggttagaattctggatttaccaccacctggctgggtgactggacagaagtaacatattctcaactgagtctcacattcctcagctgcagaatggggacagaaatactttgtacagttatatgagaattaagaaaatgcacacaaagtgcttagccagtggctaccatgccctaagactttaacagatgataactattaccatagcctattgttaatggctgtaataaagcctgttgtttttaacttttattaacttaaagaataaatgttgcagtttgactcagtgtgggactataattgcaaagcaactcatttatccacacagcctcctttctgagaattagaactaatgtacttagaaggatttgactgaagttctgctctggattttcttaggaattatttgggcaaccatgtccattaacacttatctagaaccgcaaggctgaaagtatgttattgtttgattaggttttcattagccaattattatttattgaccatatgataggtggaatagataagtatcacaaaagacatacgattcctactctacacatttagaactaaaaacagaagggcatctttgatttacttaaagggtccactttgtgctagatataataccatgccctagggatacatagatgaaaagatagccccctactctgaagaaacttatggtctagtatggtgtctagaatggaacttagaagccacttcttataggaagccttccctaaacttcaggtagggaaaatttccctcttatgtcatagcccccaagcttacacttaagtttggcatttgtcacactgtagattgtctgtctcctatgctagactgtaggctgcttgagaacagggactatgtcttactcatcaccgaagaaaagaagatgactaaaacatcatcttggcccttgaagaacttaaaattgagtgacaaatataaactacgaacatctgtaaacaactaagctcaaaatacatttttatgaattataaattctacagagtatatgctacaagaggtaggaggttttggaaagatgatttagaagatacggcatttcagtttagaaggaatggtgtgatttccatggttgaggtgggcaaatgaatccaaggttaaggaacatcatgagcaaaggcacagaatcgggactgtacatgggctacttaaggaatagtaaggagttccatgtgagtggactctggtaagaatgttaggtaggggattggttgtagctgatcttggatgcagtagtagggtgtttggattttcttctgcaggcagtggtgcattgacaaggatatttgagcaaaagggacatgattactttgtcaatagtgtaaatgatgggaaaagagagataatattcaggaaggggactcctgggactgccaataatgtagacaagaggtattaaggtgagaatagatatggaaagggaacaattctggaagcattgtgcaaattgacttgtcagactctaatttggaataagggcgattccaatttaaaagtccttatttcctacctcggtggagcttgcagtgagccaagatcgcgccactgcacaccagcctgggtgacagagtgagactccgtctcaaaaaaaaaaaaaaaagagtccttatttcaaaggtgatggctctagtttacattctccgtcatttacatgctctggccatggcatgggtaaagtcactcagaaagcgtttaaagaaaagccagagggaggtcacagaaccttgtggaaaacttatatttaaggggtaggtaaatcttcatatttagaagagattatgtttcaaaacttactaaaaagacaaaaatgggctgggcacagtggctcatgcctaaaatcccagcactctgaggccatggcaggaggattgcttgagcccaggagtgcaagatgagcttgggcaacacagtgagaccttatcactaccagaaaaaataaataaattagctgggcatggtggcatgtgcctgtagtcccagctactaggctggctgaggcagatcacttgagcccaggaacagtgaggctgcagtgagctgtgattgtaccactgcactccagccttggcaacagagcaagaccctgtctcaaaaaaaaaaaaaaaaaaaaaaaaaagaaaactcacatagttttcatcctttaagtggtttgcttaagttaacatctggtttatggcagagcccccaacccctgacatgtagctcagtgcactttctattttatgctctagattttagtttaatgctaaatgtgaggatatcacctaccttttccatcctcatctatcttagtaaaccggattaaatttgaattctggacccctctactttaagtatcttctatctcagccaggcgtggtggctcacgctataatcccagcactttgggaggccaaggctggcagatcacgaggtcaggagttcgagaccagcgtggccagcatggtgaaaccctgtttctactaaaaatactttagctcggcgtggtggcgcacgcctgtaatcccagctactcaggaggctgaggcaggagaatcacttgaacctggggaggtagaggttgcagtgagccgagattgtgccattgcactccagcagaactccgtctcagggcaggtgggtggggtggggggggcgttgaaagtatcttctatctcatatgttgatagctaccaatagcaaagagaaaattgtgccactggaaaacagggcaagtcatctatatggatgccacttaaaattatgtgatatgaattgatataaaaagcctaattaaatctaccttatgtttcaaaggcggtaagttaatcttttacattattgtttttatactctactctttatgtaaaagaaaaactacttcattttcaaatggtaaattattatcacccaaatacattgctgtatacagaagtggaaagattttgctcaaataagccaaagctaatgatttcattataattctatagaagtttttgttggtactaatactgtaattgtctatagcatatgccataggtattgtttgaaattgtttttatctcttaattatcaaatgaaatatacctcaaagagggaggcctgaaaagacatgaaactttgaaatatagagcatcttaaaaagcaagtacatggtgacgccagtcttcagaatagcatcatccctgttgaacagcataaaaaatatatggatttgatgatctatttggctggaagataaaaaatgaaccatcatgagccattattaaagaggtgtttataactgaaaaactgtgataaaggtcagttgacaaaatgagtggagcactgtaaatactaagagttgatggcccatgcctagataattcagtgtttctattcttagaaaatggattttaaccatttgaatgggcctagtaaatgatcctattacaattttcacatatcaattcatggtttacccaaaaagatgtgcagcatacttttaaattggcctttttctggcagagagtttccagaaaaataatgtgtttttttttgttttgaatttatttgcttactttgggtttttcttaagcaagaatattaaagtacaatatacatacagagaagtatgttttctaaatgtacaactcagtgaagtttcacaagttgaatatacttacttatccagcacccagatcaagacacaaaacatcaccagcgcttcagaatctaccatctcttacttccttccaatcaataggtacttaccaccctaaaagtttattgggagacaattctcccatgtgtctcatgtttctgcatatcttgtgagcaaaggcactgactgcgtgtgttcagaatgtctttccaaggcagccttggaagaccatgtctccagagcaaagggcaggtgtgcttatagtcttgaaaatagagattatgtcccttagagagcaaagaacaggtttacttactattcggtataatagagatgtctcccttcaaagcgaaaaggacaggcatgcttactgcccattataaaagattcagattccctatgttccctacaggagttcctctcctgtaacacaatccactgtatgtacaggtgtcacttgactttctgttgccttgtgggaattagagctcagggaaccagtgcaaacactgacactctgactattgagttgtaaggtcctttgtctctgacctagcatgtaaggctaacttgttaagcttgcaaggagcgtaaatctcagacccgtcactgtccttggtagtaagcactattctgacttctaccaccatagattagttttacctgctgttacacttcatacataaaagaattatatagcatgtactctgtctggcttcttacatccaacaacatatttgtgagattcattcatattattgcatgtaggcataattctttcttaatagtataccattgtgtgaacattttaaaaaattgggtttttttttccactattgatggacattagggcagctcccagtgtcagctattaaaattctgttgttagaaatactttatgcatgtctttgagtgaatatatgtatatatttccgttgggtatattcctagaactagatcagagggttcgcactggtgctgccaaacaactttctaaagtatctgtacaaagctgctctcccataaacagtatatgggccttttggtatctctgttattttcaacctttgttattttccatcatctttgttttgttttttttcagtgacatgcttcaattttaccatcatccattcataaggaaagatcccattggcataatggaattataccattggcataaaataaatatgccaatggtcgggcggatcacaaggtcaggagatttgagtccatccttgttaacacggtgaaaccccgtctctcctaaaaatacaaaaaattagccgggcgtggttgcgggcacctgtagtcccagctactcgggaggctgaggcaggagaacggtatgaacctgggaggcggagcttgcagtgagctgagatcgtgccactgcactccagcctgggcgactgagcgagactccgtctcaaaaaaaaaaaaaatatgccaatggtataattccaatttcacaaaacaatctcacaagcacttccactctttaggctgaggcaggtgaatcatgaggtcaggagttcaagaccagcctggccaacatggtgaaaccccatctctactaaaaatacaaaaattagccaggcgtggtggcacacacctataatcccagctactgaggaggctgagaaaagagacatgtcaattactaagttgttaccaggacaagttatcaaaaaggacaatgaaagccataaatattttgtagtttatttacccatgaacacaatagtttccagtcttccgcatcagataagaccaagttattcaaattaaaatgttaaagatacggttttaacagaaacaagaacaggctgaaaactgccatgaatatccatatccacataatgtacaaaaaagaaagactgatattattccaaatatttctatttgaaagtaaaagaaaatctgtacagctgaatcttcccagtaaacagaaagagaaaatattataacacagtattaatcttccacataagtaaggccatatgcaaacaagaaagagaacacccaaaattgcagtgtttcttcaaagaacccttctctagggaacatatttaacactccaaccatcttctattcttctacgtgcatactaaaaaaaagtacttctcttcccatcataactagtcaacccagtgtaaattctaggcccgattttcccctgaatcatttctgcctttttgttcagttttccctgcctagagcacccatcacaatctctttagttcttctatccactctgaactagaaatcacctttcattccatacagctctgtagtcctttaaaccctctaggaattgctaaagaggggtgaggggctgagaagaaaggagaatgggcaataagaggtctggcagtctattttacagaacagcctgcctctggacatgacaaagagagccaagaaactaaaaagcctgcttctgcggatgtttctgaactactacttttgttttttttaaaggaagacagaagagatttatgagagatgagagaaaagaaagtgtacactcactctggcacttcattaggttcaggaagggaggcaaataaaggtacctagattttgaatgaatccactggttgtggctgagaaagcctggtacttgtcaagaacaccaacatattaaccttgccatgaggatagggtctgacatgtcccctcaaccacctgtctaacaaacagtagggtttctgagtgatgagggtggtggtggtaaagagaggtcttttggaagaggaacaggtcttttgtgtgctgacaggaaagctgtgtccaccaccagtgttctggagatccctgtttattagaaaccagagagtggagctggcaatggtctgggatatgttcactcagcagggagctgcccaagtagcagtacttgggaatagccagtagcaggcagcaataggtgaccagtctcaggaaaagtaatggggtcccataattcacacagaccaacttgccccctgctgttctcccttgacttcattaatgcccagcaattgtccacaggccatgcacctgtactgtcagatgcagagcagggtgagctgaataggttcttagacacagctagaaatccaagtaggaggagccagaccagaggtcctgggaacaaaccgagtccaaacaaaggtaaatacagtgtaacctacagcatcattcgcttcgcttagaaggatgtgacccatcggctgggagcatgtgatgttaatgcagaatagcaagacgaccaggtgaaaggggagcagcacagccaccaaggtctcaatcttcaggttgagagaacggaaagtttaaacagagggtacaggaaagtcagaacaaaaaaagtaaagggcatacctaatgctgttgcccaagctcaggtccagctggtggtggcaggcaaccttctgcaggagtaattccaaaggcaaaggttaaccacactggaacccaaagggcctggggatctccactggctcccttaccaggcgacgtctagctctatgggcgtcttcacccaacaggtagtactgcagtggatttgaccagaggtcctctttaataatctgagcaatcctgtcggactctggaaggctgtggtctgaaaaccaggtgaagaagctgcagatgacatgtcggttcctatgaatgaaggactggggtccatggccccggcgccacatgattagagtggaaaaagacaccacttggccgaaggatctgacctcatacacctttacaatcagcttgtttctgaagtaagggtttctttgaaagaagaacttaaacttgcagcctgtcctagggtgtctgagctccttcacttccaaattggttaagtagcttaacatctcggcatcttggcctctaatcatggcagacagctgtgggtggtggcggaaagcagtgacccagaagcccgggatattgcgaatgatgtcattcctctgctccaggtagtattcatgaatctgcccaaacctgcgctccacctgcaggagcgccctgtcagcctctgcattcacggagtccagttccagctggatggactccagggggttcaggtggagacccacgttcaggggcccgggcccgggcccaggccctgcctccctgtttacctcatctattgctctgttttcttccgccacgtccatttcttcgcctcctggcttctcatccactggggctgagaacatggcacactcctcaggcttcacgtcctcggccttcccctctgcaatcacttcagactccgacctccctgccccacaggtttctagagccttctccccacctaggccgtgcgtctcttcacccggaaagccatttttgaggctgccgtcagttgtcagcgaggcagaggccgcttctaggccctccgcgggtggtggagtcacttcctgccccgctttgatggctccatgactgcgacccgcatcgaccaagatgtggaaagtatggccaccatctgcgggatcctggggcgcgaccccctcctctggaagccggggcggtgggaacacgattggctccaagcggccatcaaacatatctgccattacctctgtcgccttgctcttttctcgggacctctggccctggtgcgggtcttccagagcatagtcgagagtagcggggctgtgaggactctccgggaggctcatgttggtagcggccagggcagcagtgggtagaggccaggccagaggtaggtagcgtcaacgttcctcacacaaaatggcgagtaaacacctcgcccatttgcgccgcccactcttcagtctcgcgacacccacccctcagtctcgcgacactcactcctcagtctcgcgagtctgtggtggtgtctttacgtctttgttattttagccatcgtgctggatgagtaatgatattacatggtggttttaatttgcatttagccaaagtctaatgagctgagaaccttctcatgtgtttgttggccactaggatattctctcttgtgcagtatccgaggcttctccctatttctctactgggctgacgttatttttcatatggatttgtaggaagcctttgtacatgctagatactagtcagtcattcttccagtataggtattacaaatatttctcttccagtataggtattacaaatatttcctcccactctgtggggttacttttcttttggactcgtagtttcgctgtcgccgaggctggagtacaatggcatgatctcagctcactgaagctgccgcctcccaagttcaagcgattctcctgcttcagcctcccaagtagccgggattacaggcgcccaccaccatgcccggtttttttgtttgtttgttttgttttgttttgttttgtatttttagtcaagacatggttttgccatgttggccaggctggtctgaactcctggcctcaggtgatccgcccatcttggcctcccaaagtgctgggattacaggcatgagcaaccgtacctggcctactttttcaccatcttaatggtaccttttgaagaacaaaagtttttcatcttaatatgtgccaatttgtcattttcccctttaccttagtgtttttctgctctgtttaagaaatcttacctctcacctgggcacagtgcctcacacctgtaatcctagcactttgagaggcggagacgggaggatcagttgagcctaggagttggagaccagcctgggcaacacagcaagaccccatctctatttttaaaaagaagaaaaaaagaggaatcttatctcaccaagattgttcaaatttatatatgccatccatctggaattgatttttatgagtggggtcacaatttctttttttccatatgaatatctaattgacccagcactgtttattgaaaagacaattctttccccatgcataggtttttaaatgtttctgtcagaagtgacataaatcattggctacagctagtcagttggccttgtctaactttaataggacagggaggtgtaatcttctcttgagcctggaaggaggaaactggaaatattggcaagtgctgtatcactcatcatgaaaaataatttgagaaatatataaaagaccaatagaattaggccaaaggacatagagaaaaggtaataataaacaggagaaatttatgtaagacaatacagagcattaaccaaagattaataataaaaggagagagaaaataagcaatatttggagagaaaattatagtcacattgatggtttaaataaatataagacaggatgttagacagctttatgccaatacattttcaaacttagatgaaatatatggcttcatagaaatgtataacttatcaacacggactgaaatgcaatagaaaatctaaatagacctagagacaataaacaaatggaatcagtagcttaaaaaaatgtttccacaaaaatagcatgaggttcaaatgattttgaggcgactgctaccaaaccttcaaggaacacataatccatttttatatttattaaacattcaacaaatatttattaaacattcaacaaatgtttattgggtacctactgtgtgcctggtactcttataggccctctggatataacggtgaacagaccaaagatttcttccctcttggggtttacattttagcaggggagaaagataataacaagaaaccaatattgcacattagaaagttataagtgctatggaaaaaacaatagagcaaggagattgaaagtcctgggggtagggagtggggaggagattgtagtatgaaatagggtggtcagaggaagcctcattgaaaatatgagattttggcaaagagtcaaagaagttgagggagtcagctagtagaaatcctggaggagagcatttcagcacgagaagtgctaagcagaggcactaagacaggagcatgtctggaatgttcaagaaataacaaggaggccagcgtgactggagcacagtgaatgagggaggctagatcaagtagggtcttgtatgatagtgtaagaaatttggcttttattcttagtgaaatgggaaattactacaggattttgagcagaggacacaaaatctgacttaagttttgcgtgaatcactctggctcctgggtgaaaaataatctgtatggtggcaatggtagatttagggggatcttttgggaggctactgcagtaacccaggtgaaagatgtttctcagaccaggtggcagcaatggaggtggatggtggacatagtatgatggtagagtcagcctgatttaatggtaaattggctatgggatctcttagttcattttctgttgctgtaactgaatacctgagactgggtaatttataaagaaaagcttatttaactcacaattctggatgctgagaagtccaatatgctgtgctatgaagtagcatgacaaaaaagcagaagagcaagcaagcacctgggaaagaatggacaagagaggctgacttgcattatagcaacccactctctcaaaaactaatccattcccatgagaagttatccagccttgcaagaaaaacataaatccatcttaacaacctgatcacctcttaaaggccccacctcccagcatggggtgtaagagaaagagagaagtcaaggatgactccaatgattttgacatgagcaactggtaggatggagttactggaagcagagatggtgaaggttataatgaggaagatctttgcaggaaaatcagagttgtctctcttttttaacatattgtttgagatgattattggacaccagagttgagatgccaagtgggcataatgagtttagagctcaggagaggtctgagatagttattcacattttgggataatcagcatgcatggaatttaaagtcaaagggttggatgagaacactaagatagtgagtcctgataagctgggccctgaagactccaaaagtataaggtcaagaaaaagaggaaaaacagcaaggaagactgaagagagaccagcagggtaggaaggaaaccaagagagtgcaatgtgcttgaagccaaatgtgtaaaggaaggtgttcagctgtgtcacagggtgctcacatgtcagttagtatgaggtctgagaattgaccgtcggattttacaacaaagagtcactggtgactcaaaaagagcactttcagtggagtggtgggggttgaaatatgtttgaaagggaaagggagaaaagaaatggagattgaatattgacaattcttttgaggaatttttctccaaaaagaaacaaagaaatgggatcatgacaagagtagtcaagctactttcagtggagtggtgggataatagcttggctggaataagtttaagagaaaacaggaagcgaaaaagtgaaaacagcgagtatatacaactgttttgagaagttttgtttcaaagaaatgggatgatagctggtggggaaatggatcaaagaacgtgtttttaaaatgggagatgaagcatgtgtaaagaagcaggttgatgtgaatgatccagtagggagcataaaactaatgatgtaagagacagaaggaagcattattggagggatgtcctggaatagacaagaggaggtggaatctagtacctaagtggagaaggagatgtcagctttaggagcatggcaagttcactagtggtaactggcaggaagtcaaagtgtgaggtgtatatgctagtaaacaggtagaagtgatagtgagatttatgaaatcgtcttctgattgcttcattgttctcagtgaaatagaaagcaagatgatcaaatgagtgtgaggatggggcaacaggcagtgggagtctgaggacagagaagaaggtatgaaatagttgtctagagagaagagtgactagactgtgacctaaagtattgtcagacaatgttaaagtcatgaattggaaatgaggcccatcagcatggctatgaatttttctccagccgcattcaacttacagctgcagtgtgaataagcagagttggatttagacctgaaacaagaagggcaagagaataattataataattgatcttagagtttaagctggaggacggaagacatacaggatgaggtcagtgaaaaggtggtctgatcaatgaattggaagattcagggtactgaaggtctcctggggtcgagtcctagggagaataagctagagggctgagagacagtggtttgagaatgacctgcaagggattagtcagaatcccattcatgaatccaaggtggtctctaatgaggtagacagaggatagggtaaggtcattgcaggggaggaggtcaatgagccaacaggccaggatgggaaggatagtctatgtgtatattgaaatcactgagagataagacaagagagaagtgagaatgaggcaggagctaaaaaacatgagaaatgagagggaatgacatgacagtagcaacgttttagggcaataggtggtccaaaccattgacaggagactcaaagctggatatgtattctagggccaaggtatatcaccactacctttcgataaaatcagttagtgggaaggcagacacctttagaattttatatttcttaatgtcacagaccctggtattatacatctccccaagggtacacatacattaggaaacatgtattttttaaaattgaaaggtgagtagtgatattattctttgagttcattgtgaagtgttattttcttttggggttccattctgctttgttttaaggcatggactagaaacagttgaaaagaataatatacaatttcaactttggagcctgaaatattctggctataatttttttttcctaaaaaaagggagaacaaggagagctatataaaatctctgaaatgttttgtcaactagaggcagaaataaagatgtggagaaagagggagagggagaaaaaggaaagaaaaatgaaaaatgagtaagggaaggaagaacgatatggcttcttgggaagagtacaatttagccactaatctgcacatcacagaattgtaaagtgtttaaattctctgggaaacagaaaaacatgatgttttaaaagataaactcaatattagatgactgaaaagagcctgtgaattgtatagtcttgttttccttggactcctcaaatattctttttcagttcttgttttgaaagggatccctctctcttgacttaaattctttaaacaacattgtttatatagtgatttaacatacagaactatttttcttagaactaggccacccagtttagaaagctgagggcctgaatacaatatgttactttcgtaagattcaaaagaatgttggtaaacaagagagggagatgtacactttgctaatttcttctgtttcccatggaaagtttatcaaactgtttgtgaaggaaatggtcaaaaagaagttttaagtgattaaccaagtagctttacagctgcagtcgtctttattgtatataaatatagataagagaggagaaaaatatttgagttaccagggcatgggaaatgatttaccttggcaaagttaataaattatgatttaatcattttctactaatgtagcactcatagaaagaaaatatacattattgtgcctggtgaaactgtaaaaggctaaaaggtctatgtagagtcctggcctgatagactagccccagagtgtttcagccaggggtgagcagagccacaggcttgtgactggacctgtgtcctggctagtgtcaagcatccccaccagtgaatgcgatacaggagcaaaatgatgcaactgctgttacagtgtttatgttacacaaaaccaaaataccagtatttataccagactcttattttaaaagtgttcagaattcaggaaatacaacagtgaaactaagtaatacgttttaaatgcaaattttaaaatagatattataaaatgtttctaatatctaagtgttagacataatcactctagcctaatttagataaaaatttttaagtattagaaaagaaattgatactacagtaaatgaataagttggttaatcatggaaaattgaaaatgaaaaagagtgcattgatgatgtcatcattaccataagagtattttttggagcaaattttttccagctgctataaaagcttccagtttctacactggtggcagagaggtgaacagagttttgctctaattcctattattttcttgagttgtcattttaggataatctctctgtgattactttttttttttagaaataactttttatggatggcaaactgtagtttttgtttcaagtaaagcatttctggttttaactgtatcatctttaatttatcctgtttgaatatagattaggtacaactgtatcaacctaattaattactgtcccattcacattccactttattgaacggtctttgaagtaggagtaagatttatgtatgtgatagaaggtttagaagctgggtgtagtggctcatgcctgtgatgccagcactatggggggccaaagtgggagaatcacctgaggctggagtttgtgtccagcgtggacaaggtagtgagaccctgtgtgttaggtcattcttgaattgctataaaaaaatacttgagattgggtaatttataaagaaaaaagtgtaattggttcagcaggctttacaggaagcatagtgtggcatctgctcatcttctggggagacttaaggaagcttacaatcatggcggaaggcaaaggggcaacaggcacatggcaagaggaggagagagagggaggtgccacacacttaagtgaccagatcttgtgagaactcactcactgtcaagaggacaacatcaaggggatagtgctaaaccattcatgagaagctgcccccatgatccagtcatctcccaccaggctccacctcgaacactggggattacatttcaacatgagatttgagcagggacaaatatccaaccatatcaccgtgtctctacaaagaaatttaaaaatcagccaggcatggtgctgcatacctgtagtcctagctactcaggaggctgagatgggaggatcgcttgagcccaggagttggagcttccagtgagttatgattgccactggcactccagcttgggtgacatagtgacacaccctgtcgaaaaaaaagctttgggttgtccattgatattttctctttcctttggaggagtatagagttgctccttcattcttttcaaattttaatatagtgtataactctttgcatatgtttcaagatgataattcagcaccttttacagtactggataatcatagtaaaataaatataccagaatttcattattttaacatacaccatatactgaactgccagaatactgagagaagatattacaatcactagttgaaaccaggaagccagcttcagtcatcaaatccaaacaaacagtgagcacaggaagagcagtaagtgcctatttattgaccaccttttgtgtgtcagggaggtgatagatgtttagtggtgaatgaaacaggcatggatctgtgtccagaattggttccatctggtgggttcttggtctcactgacttcaagaatgaaacgacggaccctcgcgatgagtgttcttaaagatggtgtgtgcagagtttgttccttcagatgttcagaagggtccggagtttcttccttccggtgggttcgtggtctcgcttgatttcaggagtgaagccgcagaccttctcagtgagtgctacaggtcataaaggtagtgcggacccaaagagtgagcagcagcaagatgtgttgtgaagagtgaaagaacaaagcttccacagcgtggaaggcgacccaagcaggttgccgctgctggctctggcggtcagcttttattcctttatttggccccgcccacatcctgctgattggtgtgtttacaatcctctagctaggcagaaaagttttccaactccccacccgacccagaagcccagctggcttcacctctcagatcctgctcagggagcttagaatgaagaaggcagaagcaggagactagccaggaagggcggaagccaggcagacagtgctgcaaactcacatgtaaaaaacaaggtgggaggaaagggagaaggtccaaggtaattgcccaaaaagggatgccggtctggagatgggtggatgcatattatacagaaacaagtagaaatcttaatgccctttcaaaaatataagtataaatttaggtggtgagttgtttcaacaagatacatgatccttgtttggggtaggggacagtaaagctctcaaaagcattcttgggacagtggaggaaattaaaatagggactggatagtaaatgtttaaaagaattacatgaattttcttaggtgtgataaatggcattaaagtatagaaaacagcattcttattctcaggaaaggaattttagtatttagaagtcaagtgttaaggtatttccaacttaccttcacaaagttcaactacaatgccaaaaacaaacttatggggagagagggaggaaagaaaatatagcaaactttaactaggtggaattatgtagctatttgattgtactatgctttctatgtatgtaggaaaatttgtataataaaaagtagggggtcaaaagataagcatgtgtattagtccattttctcactgctgataaagacatagctgagactgggaaatttacaaaagaaagaggtttaatggacttacagttccacgtggctggggaggcctcacaatcttggtggaaggcaaggaggagcaagtcacatcttacatggatggcagcaggcaaagagagacagcttgtaaatggaaactcccatttttaaaaccatcagatcttatgagacttattcactatcacaagaatagcatgggaaagacccacccccatgattcagtgatctcccaccaggttccttccacaacacatgggaattatgggagcttacaagatgagatatgggtggggacacagagccaaaccatatcagcatcctactctccttttgacaatggatgaggcagctgaaaggaataccaaggagaaaggggaagaatgcagggtgtggcctattatgactttgggcaaacgcttaacctctttgagcctgagttttcttcctctgcttcacagataaatatctacatacaggggtgatatgaagattaattaaataagttgaaatgtagtggttaagagtggtaagtccaaatctcaaactgcacttagttactaaataaccttgggaaagttacttttgtgcccagtttccttatctgtaaaactgacataataatagtgcctacctcccagaattgttgtgaagcacagaattgttctaaagagcgaagcttagcatatattaagtatttgataaatattggctctcattatttttgctatctaggactcagcatcctgaaaatagagaataccccttcttttcacgtgcccattggacattcacaaaaattgagaatttattatgcccataaaaaaacctcaatatattgcaaaaagtagagtgtgagcagcatgttctgagaacagttctgtaattgctgacataagtaactctctaaatcaactcttgggtcaaaaaggaaataaataaattacagaacaccttcaaaataacaataatggaaacctcatatactagaacttatggtctgcaactaaaggactttttagtattacttgtgaatattgatacaaaaatactggataaaatatgagtaaacaagatccaccaacacactcaatcatttaccacaacccactggacatgcccatgccctttcaaaaatataagtatatgatccttgtttggggtaggggacaggaaaactctcaaaagcattcttgggacagtggaggaaattaaaatatggactggatagtaaatgtttttccaacaattttgttttagcaaattacatccttatcacaacaccctataaaccaggtactatcattggccctgttcaacagataagaaaactgaggtgcagaaatatatagatatagatatagctagataaagatagatagatagatagatatagatatctatctatctttttttttttttttttttttttttttttttttgagacggagtctccctctgttgcccatgctggagtgcagtggcgcgatctcggctcactgcaagctccgccgtccgggttcacgccattctcctgcctcagcctcccaagtagctggtactacaggctcccaccaccacgcctggctaatttttttgtattttttttagtacagacggggtttcaccgtgttagccaggatgttctcaatctcctgacctcgtgatccgcccgcctcagcctcccaaagtgctgggattacaggcatgagccaccgcacccggccgaggtgcagaaatgttaatttgcagatggacacataggaaatggcgaggcgaagaaatgaacccaggcaatctgagcctataaagctcttccttttaaactctacggggtactctctgagccattctcagctacaaaagagggttagtaattcttatctcttgtggtggacaaggtaagatacggagttgagtggggagaggcattgatgctatctttatctgtttctgtattgttgagttgttataatgagcatgtattattcatgtattttttcatcaagaaaatgttttttaggggcctataaaagtgcctggcacaaagaagctcccaataaaaacattattatgtctgaaaggaaattcagaatttccatttgacttaataggaattcatcagctccggaagctgggtgaagaaaagaaacaagatagggcaacagctagaggagaattcaggtgagaggtttctactttcaaatgagaagggcttatacatcctaaagtaaggggtgggaacagaaggagggagaaggaattgggagctgggggaagagtggtcctaaagcctccctagatgaatttaattatttgggggaaggttactagtgaccaattgttgacatatatataagccccatttcatacatgccatgaataataggcctccctggggtaacaaaaatttaaagatcattctggaaaatgagacaggaattaaaagaactctatggcttgctttctttatctacctggttctggcaatgtgagaataggttttctgaagaggagccaatagtttgtttttccacttgtgggttacaatggtaaaatgattgttggcaaaagaacatcttttcaagcagcttcccttggtgtaggtcagaggggcaacaagcagagttatttctgcagctgggaaaaaggttcagagctatcttcctagaatcggctcttgtttcagaatctaaaatagatttgaaatattgtgctatttgggaattggggcctattcatgctaagcacatctgtgggtagctgttgaaattcaaataaattcaaataaagtccaagtaatgctcatactacacttaccaatttcaaattttaaaaatacatatatacaatacctgcaccccatttggtatcactacctaagacacaatatggaaagccttgattttctgccagccatagctgctttgaacctgaaccacaacatttaattcctttgaaaatgccccttcctccctacctgaacttttcaactgagattcattttcaaaagtttaaatatgaactatagcaaatagttctatattttggttttgatcatttgacagactttagtagctgcaatgaggttgttggactacttaagtcataaagccaggattgaataaatgcattttccttctcgtcatctttctgatttcagtaaatacagtttacttaggtgtggtgattaaggaaacctggtcgatttatttatacactattccattccatattcaaggtgtcttttaaaaggcaaagtaagggaacttgcctttttaaatttaaccatgactttcttatagtgatctacccaatgtatggaaagaagtagaactggctgggtgcagtgactgacacctgtaatcccagcaagttgggaggctgagacaggaagatcacttgagcccaggagttcgaaaccagcctgggcaacatagtgagacccagtctctaccaaaaaaaaaaaaaaaaaaaaattagctgggaatggtggcatgcgtctggagtcccagctacttgggaggctgaggtgggaggatgcttgagcccaggaggttaaggctgcagtgagccgtgttggcagcactgcactccagcctggagcaagacccctttctcaaacaaacaattattttaaggttgtgagtttttcttttttttccttaatagttaaaaatttgaaaggcatttaagtgacatattcatgtcataacctgagagtttacaatgttataagtaggtaacacattaagcacattatatgaattatctcttaatttaaacctcataattacccaatgaagtttgtgtcatcatttccatcttacttataaatgtatccaaggcttacaaataagtaatttgtccaaggtcacacactcagccaggagtgaaactgtgcccattattcaaattattaactgttttgatttttattattatttgtagagacaggggctcactatgttgcccaggctagtcttgaattcttggccttaagcgattattccaggtcagcctcccaaagtgctgggattacaggcatgagccactgtgcccagcctgagctgttaactcttaatctaaacaatgccttttacatgagaaacagtaaacaagatggcaagggatggcaaagaggatactgaaatatgttaggagctacatacaagaaataaattcacagttaaaagatgaagacctttatctaaatccaggcaaactgcaaactttaaaaagaattatgataagaataaagcatcaggaaggagaaagacaaactgatgacactgatatcccagaataaggccccatagacaaaggtataaccatcatcacatatggttggtgactcccacagcgtgttcctcaccttccccagtgcctttgggaaatgtgagtgttctctgtaaaagttctggcatggtgaaagatcgtaactctaggaagctgaataacttaccatttggcactaatatccctgatttcttctgtttaacttttttgctctcatctctatgttgaaaaatgcaatagatgttaaaatcagtaataatgttcaataactagtacagctgttcccttgttccacctcaattttatttatagaaaagccattattccactattctatatcaataacaattttcatttgtttttctacgtgtataatatgaattatattaaataacaaattttccagttttcataataataattctaatgactatataacagtctgttgagttgatgcactgtaatttatactgggtattttgtttccagttttttgctattataaatatccttccaagaatttatttaggcatctaatttacttaaatttcttcatatgcaaatagtatgtttatgtcctctgaccatttatctcttgaggttttaatatttttgaagatttggataagtccttaatttgttatgtatactaacttcttccctgtttcctaattatgtttcccttcttgtgtgtttcaatcattgttagtttttttatgttaaaatcactttttcttgatgtttttaagctatttttttgtgtgatttccattgttgccataagcttttcaaaaatgctgtctaaagatttcacagatatttgatgcatatttctcctagtttgctaaaaattaaaggatatagttaactctttaatgcactatgatcttactctgctatgtaccataagtgctaatttaaattactttttgtttttgtgttttttagccagttatcctggcaattattaaaacataattagccagacatggtggcacacatctgtagtcccacctgtttgggaggctgaagtgggaagatcatttgagctcagtagacgaggctacagtgagccatgatcacacaactacactccagcctgggtgacaaagcgagatatatctcaaaattttaaaaataaagataaaaaataaaaatgaatacaatgaataaaatgtaattactaacttattttttcctaattttatgatagtatatgttgaatttatttctacatgtcttacactgctttattcaattagtgtaataacttatactttaggttttaggatttcctggggaaattctggagactagagcagcatcataagtcacactttctttgttagtgtggaatttcaatatttaacaaacagtaaataacttcacttggtgaacattgtttttctgtataatatatatctaaatctgtttatcttgttttgtatagtccattaaagctttgtacttttctttacatatggcacatacaattctttatcattttctttataaatgtcatggtttgaaaccacgtttgcagagatgataaaagtgagagactgaggcaagatgcttcttgcctcacaggtggtgctccttgctcattccagggcataggccaagctcactatggaagaaatttagtttatagtttgactttgaaccaaggatgataatagtccctccctaagactgatcccctccttgtccgggactgaagccacctttgtaaaactaatgaaaggccacaagattagtattatgggaggagcctcaattctgctcaaatgtaggcatagtttctataatcccttactgctcagtactcatgtggccagaggtcacaagatttaagacttccccaattgcgcccatagataacatcactattgtagaacctacgattgggtttttgagatgttttttcacttttgttttctggcaactgactgaccatatccaaccagtgactcatgactcaaccagtgtgtcctgtggccccccacccaaaggaggactcagcacactgggatcattttccatacccctgtgatttcatcccaaatcaatcatcggcacccattccctatccctctgtgcaccaaattatccatacaaaccctagccccttatcagagagactgatttgagtgataaccccagtccttctgcttggcagccttgcattaattaaactctttaactgcaataccaggacctcagtaaagtggttttttctgtgtcccctccacccttttttgtggctatgttaaatgggatttcttctctttttgttaaactagtggttaccacaataaagaaatcccctaattatagtgaattcactataaacctagtcactttgataaactcacataggctaataagcaaatttcttaggatttttagacatgcattgctttctgcaaataatcatagttttctctcaccccttaatgtatcattctgttgtcacgaagtgaatgcagttgccattattcctgtattagagtgctaggctggaaaggcaagaaacatacatgttactttcagttcctcaactgaggaagccattgatgaagcaccttcttttcatggatcaagcaccatgctaaacacttcatatcgaccatcttgcccaaggctgagaacaagcctaccaagtatacaattattaaatatcagtgttgaggaaactgaagtttagcagatgtaggctgcccgtgttaggccccaagaagcaataaaaaatggaacactgaggggcctaactatgggggtctgtgaatgaaaggctgtgagtctgtgtctctgggctcctgtgactggcaggtttatctctacccaggagctgcattgaccatgaactttggccagtgatctatgaggaactagggagggatctcagagctgaatccgctcgcttgcatctgtgtcttgtgcatatgcttcacacttcctgtttctaggtcatagtaagtctatgtgaaagtaatcctgaaggtagtctatgttcttgttttcactgctctccaacccatcagccctttgaggttaatttatctcagatcttagaaatagcaaacgatggagtaagtggcttccttcacgaccagtggtctttccattgtaccaatgatgtcctcatccaaatgtaagtcagataagatgatccaattttgacaggctgactgttcctgaatatgcattatacaaattctcacagaggctatactgtccacatccttgagttgcttatattgctttgcacataacaagtattcaataaatatttgttgatgcagaatgaatgaatgaatgaggcaaagacaacagtcttaatgcttttcctacaagagagactttcaatgatagaatacaaactcatgtggtatctcctaaaaatctcaccatttcacatttcaaatgtggaagcttctataaagactgtatttgtcatgagccttttcacaagaagatgtttagtaccaggtcagcttgttttcatcttgttttcaaagaattggggttaggaaagcaggaaactaggaaggatcaaggtgggaacagtggtaggcaggcttttctctgacaaagttgtttgggttatttttatctttctgcttctgttacagcaacaatatgagaaaactgactgttcaaatttaataaatagagtctgtccaaacccaattttgaacaaatgacaaactatggtgcacatgcattaacatttctgtttgggtatgcaatgggaaactaagtcttatgttctcgtctgtaatttaaacatacaaagttttaaatgttccattagaagatatactacaatactagtacattaattgagtgttctttgttatgccaaaaaattccaaaggaagttacacagcccctagaaggcatagaatctgtagattttgtaattatggtttttaaacttaaaatctcattgaagtcattagttaacatttctaaactttttgtttgtttttgttttagacagattctggctctgttgccaggctggagtgcagtgggacagtctcacctcactacaacctctgcctcctggattcaagcaattctcctgcctcagcctcccgattagctaagattacaggtgcccaccaccacgcccatctaattttttatatttttagtagagatggcatttcaccatgtttgccaggctggtcgtgaactcctgacctcaggtgattcacctgcctcgacctgccagtgttgggattacaggcatgagccctcgcacctggccacatttctaaacttttatgcctgaataattctgaacagatattccaataaccttcctgccctccacctcatcccagccaaagccgggagagagggaagacctatactaccaatagttacaaacagttatttttggaattaaaaacaggaatttgcaccatgaacaagtgtctcgttttgtcttctgagcttctcaaaaaccaccattatattgagactataaaattgttctttaggctgggcaagatggcttatgcctgttgtattagtctgttttcacaccgctgataaagacatacctgagactgagcaatttacaaaagaaagaggtttataatggacttacagtttcacgtggctggggaagcctcataattatggtggaaggcaaggaggagcagtcacatcttacatggatggcagcaggcaagaaaagagagcttgtgcagtaaaactcccccttataataaccatcagatctcgtgagacttaccattgcaagaacagggcaggaaagacctgcccctataattcaatcacctcccaccaggttcctcctatgacacatgagagttgtggagatgagatttggtaggggacacagccaaaccatatcaactgtaatcccagcactttgggaggctgaggtgggaggattgcttgagcccagaggtttaagaccagcctgggcaacatagtgagcccatttctacaaaataaaataaaaaattaaccaggtatggtggtgcacacctgtggtcccagctagtgggaggatcacttgagcctgaaaggccaaggctgcagtgagccatgttcacaccactgccctcaggctgggtgacagagcaagactccatctcaaaaaaaaaaaaaaaaaaaaaaaaaaaaagttctctgaaactaaaataaaaatctagggaaattaaacattttttattgcaaatcacttaaccttagaatgtcaaagattttccctaagtttttatataaaaagaagcatgggagagagccatagggaatcaaaatttatgagccacaatatttgcaagaagagaaaacattacatcagccatgcacggtttctccaacatggatacaaagcagaatgatgtaatagcagctgcagttttgtgctaccacattaaacagtggtgctttcgatatcatttaactaaaccaaaatatgcagttcaacctcacatagctcaaaatactcagttcaacctgagatggtcctgaattaactagaccatgtttcaggcttctgaatattatttttaagttctgtgtaaggtaaggtataaaagaagaaaaaaaacctccttgcctcaataactttggttttaataaatgcaccaataaatttatttgaaccctgagttaaaatgattcagctctagtggatgaccaaattgaggctgcttttctttatttattcaagttagatttcatgtaaacccttaaattgtatgaattcaactatcatttctaaagcagccagactaatatgaacctaaatctgagtatacttttccagaaacagctgactatttaggtctcgttatctgtcctgtatctcactatcttcttcccaaccacaggaaactgaggattggctactgactatttgaaattggctatttcatagaggtaaaaatctcatcagtatgctggcaacagtctttaattttgaaagaggaatagtcccacttgactatttctagcttccagtattaggtcaggagagaaaacatttctttagaaccttttccataaaatcagggaataatttaggaatggggaaatcttctagtgttttatttcagctctcctagggatgtgcttcccaaggctttgacagggagaaactgatagctatcagtgtgaatcagctttgtgtctaacaatttcctttctaaggaacatcaagcatagagaaatgattaagcatatttatataatctaacatattaagtgaattacatttaggtgaaattggaaagtcagcacatattgctttataatgaacatccaagccctgcttgatttgcctaatggactatttgataagggcaaaatacattctgatttaatggaatttctaattagttaatatttagtcaaagtgcaacattaagcgtatccctaattatatgtatgataggagtttacaaagcaattggtatgggttttatatttacatttatatgtcatatatctttttctgaaaaaaagttgaaactagaacttaaatagcttacatgtttatcctttctatccttgttaggaaaaattcctttaaagagattacaattattactgtaccccgataatcattattatccttgtgcttaattttcattcctctaacctatcctttaccttgagtttttatcccaaaatacaacttcatccatgtctttacagaaaaaaaagtccttagcaagctgtgcaagacccttcccctctggccattgtcccaatagcatattttagttaataaaagtctctcactcaaaatgtctggtgtctccatgttgttagtgtaggtatttcagacagcattctcctttgttaaacatcctacatacattagtctaatagttgtcaatgttataacacttatttacacactgggggaaaaattacccttgcattaccatgatggagttactaaacccactgagaagactcaataccatgggtagaatcttcattagtgtttaactctggatgtcattacctcccagctagagacattgtcaataaaatttcagcatttattgtaatgactttgactttgatcatgaaaaccacatttcatctttttctttgggttcagattgttctttcacacacacacacacacacacacacacacacacacacacacacaccacacacaagaaaaattgtttttttcctttagggactttctcaaaccctttcataatcttttgttaattttaaattgatatttactggagaaatttgaaaataattaaaaaaggaaagaatgaaagccattcttatttcacggggtaaccactattatccctttgatgcacatttcccaaatattttcctgtccatatgttattttctcacaaaagtggggtcatccgctacatcctgttttgcaacttgctttttaaaaaagcataataccatattacaatcatctttatatattagtaaaaattcatcttcataaatttaatggctattatttctatttatggaaataacatataaaaaatcctaattattagacatttaaattgcttgaaacactttcctgttacgtacaatgctgtaatgaccattcttgaggcaaaatctttacctacatccttgattattaggatagaattttaggagcaggatcgctgaatcaaagtgcatgctcattttatttgtttacctatttaataaggcaacacaggcaagatgtacaaaaattcagaaggaccaatgggagattcagtgacaaataactctccctccttccttttccctcctaggagacagctacttttaatagtttccatttatttttccagagatatttaatgcatttatataaacacacacaaatcctttaatatgcctattaagaaattagtaaaatgggccgggtgcagtgactcacatctgcaatcccagcactttgggaggttgaggcgggtggatcatgaggtcaggagttcgagaccagcctgaccaacatggtgaaaccccgtctctactaaaaatacaaaaattagccaggtgtggtggcatgcgcctgtaatcccagctactcaggaggctgaggcaggagaatctgttgaacttgggaggcggaggttgcagtgagccacagtcgtgctactgcaccccagcctgggcgatagagagagactccgtcttaaaaaaaaaaatgatttcaataatgaaaattgttttataatttcatgtgctagataatcataggcacaaagctttctacaattaggcaacattcattatttcagttctatattatttcttaatttatattttaccttacctttatgtaataatatattacttgtcatttaccatgatatttttatcttcattgaatactttaaaaacattttattataggaagtttcaaatgtacccaaaaagagaatgcgataaatccccaagtctccaactactatgcacattttaattaattaatttatttatttatgtatttatttatgacggagtctcgctctgtcacccaggctggactccagtggctcactcggctcactgcaagctctgcctcccaggttgatgccattctcccgcctcagcctcctgagtagctgggactacaggcgcccgccaccatgccgagctaatttttttgtgtttttagtagagacagggtttcaccgtgttagccaggatggtctcaatctcctgacctcgtgatccgcccgcctcggactcccaaattgctgggattacaggcgtcagccaccgcacctagcccattttaagtctttcaataaacaatgccaggtttttctctatgaaaggttttttagtgagacttaccctatcttcattttgttgagttgaattttatagctgctgaagccagggttacatcttttagcaagaataaattggtggttggaatagaaaaagtatagtaacttttgttgcactgtgacaatagattttatctggcatggtaatgccaatcaacttggcatcatttcctggctcagcgagttggaataattatgagaatccattcagagtctgtggggaaaactgctaggattgattagcaatgtctaccattggaaaagtagagaattgttggcttttatgacatagacagtttgccgattctgctttagcttacatgcataacagcatacttttttttaaaccattcttttgcttagtagccataaaaatcaatttggcttatttaaaagtttcataatgaaacatacctatttacctataggtttcttttgccagatattatattaacaacttttcttaaaaataattttattttttgaaaggaactaaataatgtcagtatatagatgctgctgtactatcattaaggaagcatgtgctgaggttgtgttctcagaaacaaggaagaatgacatttgtccagtcacggagctctgtggctccatgcagggccatgaatttgttgatgtctgtgatgtacagtcatggaacagagagaagctaactgacccatgataagttaaacctcaaatcttaccacttttaatgccacagtaaaattttctaagctggtcaaccacaacaaaggtatatttaaaaactaatatgaagtatatcaagaatttaagaactgctgtttcatgaacctatggaatggcagatctgaaagtcatcgtggagatcgtttagaccaggagcttgcaaacgatagccagtgggccatatccagcccactgcttgtttttgtaaatcaagttgtactggaatactgccaggcttatttgtttatgtattatctgtggctgcttgtgcactatagtgacccagttgagtaaatgcaacaaggctatatggaccacaagcctaccacatataccgaggctatatgaaccacaatgcctaacacatttactatctggccttttattgaaaaagtttgccaactcccgattttaaccaacttttcattttagaattatggaaattagaaatcacagaggttgtgtaacttgtttgggataattctaccacttgagaaaatagccaacagaattcccagaacccccagtggcaggatccagagctgcagtctctatctgaaagagagcattttcacgtctctggaagccctaccctaccttgtcagccatgctgccactccctccctccccacttcacacacttaatgcaataaaggcaaaatgaatacatggatgaaaactctcctgtattcatagaatatttctcacattccttcatcattccaagtattatacggaattgtaatcatttgcctttcccactagaacatgagtgcactggggacagggacaatgccatatttgtctttgtatcccagatgcttagcacagattacagaataggtatctattacctgtttgttaaatgctttggatttgctatcttatcttcttccatgcccattttaagataaacttcaactacagggaagataaatgcaagttgtggtttgtaattttcatcattcctgaccaagacccaccactgagacccaacaataggagatatccagagccaaacaccatgataggaaagttacaaatctgtttttttcattgcacctactaaggaatggcccaaagcctccaaggcaatcttgacctgcatccctggcaaacagatgagaacctgatgtaagtcagggataataagagtgaagaagagagagagatgaaagattattaaaatcaagaggacatcatggttgattgactgtccagggggtggttgaaagtctgtgactgcccagattctgccaagtttcagaatgcaggaggaagagcacattgggtaagggaggtgtgggtgggaagggggcatggaggtagaggcagataggatacaagcggggaggttcagtagtcaatggtatatgaagctgcagctttcatgataaacatgggttcagatgaagtcattcagagagtaaatcaagattaagagaacacaaaattaagcctagagatcaccaaaaggattgaacaaagtaaaaaggaactcccacttagaaggatcacctagagacacaggagggaggcaaaagggtagtgtcccaaaagccgtgggcagagaaaaggaaaaatgtcaagtaagatggcaaaacaatatatgcctttcatttagcaacttggtggtctgtgacaaccttcctgagagccgttttagtggaggagttgtcttggaagcctgattcaatgggtagaagagtaagtgtgaacttgggaagagacattgagtatattttactcttaagaaacttaatcgataggaagaaagagaaatgagatggtaactggaagataggtttgtattccactgagtgggtagcatcattgatttgtgaattctttgaagagaatctaccaggtgtcagaatcatagagggaaggtatataaaagccaggtgggagaggaaacatcaccaagaagaggaggaatttatctctatgaggctaggtcttttcacttataaatggaaataataatagcttcctcagagagaagttggaggtttaaacgaaataacataatttaaaacattttgaaaacagcaaagcactattcaaaaccagattattctatatattatcaactccagttgattaccttgactcaatatctgattagtctcaatcttagagtccaattatgattaactttgtcattgcagctcagaagtcagggatcaatttccttttcctgacagtgggatatattctgatgccttggatgccagataattcttatttacttcagttatcaaattaagtaccatgtttaaagcaaatcagtggtgctgccacagtgcacatgcatagtcaatggatgttataggagatacagatgtctctgtcagtaggctaaggggtgcaagttactagcctacatgatgatacccaggacaggtaaagatgagatgatgttggtggctagacaagatttcagtcgagtaagacttcccatctccttagaattatagtagcaaagatatcatgtggcagaaatcaccagagctagactctggtgaaacccttatgctcaattttttgtgatgtggaagttccttctaggctctggtattacgaagtaaaattaaaaagccaaaatcaaaagcttactcttgtgaatcagagtgttacaactcctggtgagagaactaggaaggagatcttgattatgggaccattttctaaggagttaaatacagattgtagcaacatagatcctagattatgaaaaatgctttactaagttttgctttttttccattacacaaattcaatttgtttgaacaagattataaaaatagtaattataccctatcagctaattatttttttagaatgaatgagttataacagaagcaagcaacacagttagcaagcatcattactgtttattttcattttttcatgtatacacttacttatttatatcctatgttcttccacaaaggagccaaagtgactgttgctatttatttcatatgttgttattcataattcattacccagaagacaccagttctcttggtagtgaaatatatgttaatttaagtatttttttgcctcaaacatctcaaatagtaaattaaaatctcttatgaaataacagaagaatatacaagttctccaagtccttcaaagaataaaaatattatttacactcctgtatctgttagggttagagattggggactttaaataaaataactaaaataacaaatgaccaccaaatcccaccgtcacggacgatgggaaactaaaatcagctttaacattttcagacaatttccaacctctcatccactcctcttttgtgtcctcaccctgctccacattttgctttgctctgccctgctctaagcagatggcccttgtggtcatatgtcaagatcctaaaactatttctgacctggaacaaagttctgcctgatttgatcttagttcaggtcacatgtttttctccatctattcctatgaatgtttaagaaaacttattcacttccttattaatagaacaaaaacatttgtttttgttctattgcttgctcttacatggttagccaactacaatgaaccactcactcctggggaaatcactagaaacaaagatttaatggataaaaacaccagactagtgacaattttttctgatggaaattgtttggaagttttttttttcttaaatatgaaagtagagctgtgtgacttataattaaatgctgattatcctctgtatggacatattcacaggtagctgtgtgtatacttgtatatgcacaggaaaggtgtgaaagaatacaccttcaaagagtggccatatctaagagtggggctgggagatgagaaaggagagctttcacttcctgcttcctgtatatcctgtttgaagttttacaatgatcaaatattattgttttaattaataatgtgaagaatgaaaatatttctaacattcacaaattaaagatgatagcatggttgatttgaaattttttatactttgcacagtggtgttttcaattcagtgatttatgacacattttgggctttatcctaatgcacgaatgattgaaaataaaaagatgaaacttaccctaattatcatacatatacaattcctgttagatatgaatatcttgcctcaagatttttattaaagagttctaatttagtcctatctctgtgactaggattataaccttttaatattgttaccaagatcttatacaaattactcattgaacaagcaattcattgaacaccttgtcaacccctgggctgagcattgagggcagagatgggtagacgtgagccccttcagttgtatgagctagctttcattgcatgctttccatgccccaggactctgtgtagtgctttacatatattaactcctttcatcttcacaacactcctgtaaggtataaatattattaaacccattttactcagatgaagaccctgagacagatttagaatcccagaggtctagctctgactcaaaagcccatggttttaaaccgtgacttcgtagtgccttctggatcataaagtagatgtaatatagtaggagttttacaagtaaatatttaagtatattttaacatttgtaattatttaacaattggaacaacttgaatttccaacaataggaagttgattaaatacaacggagtctacccatacaatggaagacttaagaagcatttgaaatgatgatgtagaatgtagacactgatctattaacattaaaaaactatctttggcctggtgcactggctcacgcctgtaatcccagcactttgggaggccaaggcgagtggatcacctgaagtcaggagttcaagaccagccaggccaacatggagaaaccccgtctctactaaaaatacaaatattagctgggcatcgtggcacctgtaatcccagctactctggaggctgaggcaggagaatcacttgaacccaggaggcggaggtttcagtgagccgagatcgtgccactgcactccagccttagcgacaactctctttatattaagtggaaaagattataacagttcttataatatgatttaaactttgtaaaaaaaaatcatataattaaaagccaaagccagactcataaaaagcatccacatgcttgtaggccaaagcaggctccataaacgattcaggtcagaatactgggggatgcatcactgatcactgcactttctcccatggagcctggacaaagcttcactcgtctcctcaacatacagccccaggcatccactaccagtctatctgaggtggccctcaagagaatcctctttatcttttgagcatttgctaccctcaattccactgctagaatctattcatctagtatttcctcttggtctcattcttatcccttatttcattctcctgtgtgtctccatgtgactcctttgtgtacacttttcttgtgactcagttttaccctggatcctggtttgctacttctattattgctctctttcacatcatcacctttttttttatcccatcattcccataggcacacaaatatgctcttgtatctacaattgttttttaaaagatgtcctctagagctacatcatctccagccctttatagcacatctccttgataaagctatgttgactgtttcttctttctcacccacctatttttctcttcattccctcccagcaggctttgctttctacctctccattgtaaccaggatcaactagtgtccttgactttgaacttgccaaatccagtgatcagttctttggcctgtgttacttaaacattcagcaacccatgagactgttgagacccccttcttgaaataccttctttgctgagcatcttcgtttcttcaggctgctgtaacagaataccatagactgggtaatttataaacaacataaatttactgctcacaggtctggaggctgggaagttcacgatcaaggcactagcagattcagcgtctggtgacagctctgctctgcttcaaagattttgccttccagctgtgccctcatatggtggaaggggctgacaagctcccttgggccctcttttataagggtactggtccctttggaatcctcatgagctaatcatctcacaaaggccctatctcttaataacaacacattaggaattaggtttcaacatacaaattttgggaggacacaaacattcagaccacagcactgagtttctaggataccacggtctcctggctttccttctgcctcacttgctccatcttctcagcctattctgtgggatgctcctcttgctgaccacttctcttctgtttccatttattcccaggtattgccatctagccctgtggcattaaatatcatctgtaatcagttcccaatttataattccagtttcaatctctctcctaaattctgttgttaacgtaggtgtctaaaaagcatctcatgcttactgtgtccaaaacagaacactcaatttccaccctgtggctaagactgctagctgtcctccagtaatcatcctctccttctattgtaatacatgtggttttactgggcacacagccactcagaataaagcctacattgacaacatctcagtctcttttgtagctgagttctggccaatgagatgtaatcagaagtattgtgtggcagctgctagaaaacctttttaacatactgcaaacatatatcatcttcctcctctttgccttcatctatcctgctgtctggaacacagatgtgatggttggaactttagcatccatcttgggttatgagaatggaggacaacatcctagaaatcatggagtggtgagttggaaaggtctctgaaggtatggagttgtcatacttgtcctggactgcccaccttcaggcttcctttatatgataaaggaatacagatgcttcttgacttatgatagggttatgtaccaataaacccattgtaagttgaaaatactgtaagtgagaaatgcatttaatacacctaacctactgaacaccatagcttagcctagcctaccttaaatgtgctcagggccaggcgcagtggcctttgggaggccaagatgggaggatttcttgagcccaggcattcaagaccaaccctatagctgggctaaactatttggcaatgcagtacattgtagagtatccactgtttaccctcgtgatctgggagctgtggtttgctgctgttgcccaacattgtgagagaatatcaatgcatattgctagcctggaaaaagatcaaaattcaacatttgaagtaagatttctactaaatgtttatcatgttagcaccaccagaaagtctaaaaaatgtgagttgaaccattacaaagagtccccccatcagggactctctgtaaactaccttcttcaagccactattactgtgcttcaaagctgaatctaaccctaactaatagtcatctatgtctatcagagaacaatcctcctttcacataccaggcaactgaaaatataaaattggtagaaaagatgatccatttttacactactttgctcaacagataacttttctagaatataattgtactgattaaggatttatacttccattttctcaggttttaaatgaattctaataaaaatctttatgctgttttgattatactcctctctaaatggatttgtcctcatctgacattttgtgctggtttgaaaactttcaaagacaggcctaaaacaaaatacagccttctcaatacataaaatcatatccaaatgtgagttttctcaggctataatatctagaattttttaactttgaaatgcaatgtttattcaatatatggtaaaaagctccgtaagtatttgtgaatgaatgacttagtaaagagtatactatcacataattatttaactacataaaattaccctggtgatttaaaaacatgttccccaattttttgatactcttttcactaaaggtgagtgcatttgtgctgctataacaaaatatcttagactgggtaatgtatacagaaacttatttcccacagttctggaggcttggatgtccaagatcaaagtgctggcaagttcagtgtctgataatggcctgatctcttcttccaaggtggcaccttgaacaccatttcctccagagggggctaactctatgtcctcatagcagaagaggtggaaggaatggaaggaacagacttacccattcaagccctttttataagtggctaatcccatgcataagggccccccctcatgacctaatcacctcctaaatgccttacttcttaatactgtcacactggcaattaaattttaccatatgaaatttgggggatacattcagaccacagtaggtgagatctaatttccttccccttgaacatgggccagccttagtgactgacttcaaactcatagaatgtgttagaggtgacactgagtgtcttccaagactaggttagagcaggcagtacagtttctgcctggctctactggacatacctttggatccctgtgacaacacacacataaaatgtctggctactttgaagccgccatgctgaagaagtcatgtagggatagagggagacgactgaggagccagagctgttgcagaacccagctgactgagttttcccagcatcatctgccagacttgtaagtgattccagttattccagtcctcagcctcagagctgctcttggcaagtactgcaaagatgagctttccctgttgagccctgaccaaattgcagacttgtaagctggctaaacagtgtttgttatttctaggtgtgagggtagtttgaacagcacccacagtattgggaacattccctcatcagcacgttgactctctatgctgcttgcttgattgtcttggagaacataatgaccctttcagtcattccctttgggttaattccctctgtggaaaaggggtattcttgcacttgcctgccactcctgtagccacaatttagagagggctttgttcccttcacctttcctctatccagggaaaatatcagacctgttgccttccaaaatggaaacaaaatcacctgtttcaaagcaagctgccttaagatgtggtctgtaaagatactacaattaagtgataggctttcccttttctttaccctagaaacagaaacagactgtgtttcagcataatgcaggtgaccaaggcatatcctccatataggaacagagcaactaaaaagaaaactatagcctcattaacttgtctgaggtagtgatttgttaagtgaaaagcagtgggtggtgtagtttttaaaaaggtgggccatattaccatttcttcagtgcttcctggggaaaaggatactatcattatgtatattctctaggccaggtttcacctaggctagagaaagaacaatctaatgtaattctgtctcattagtgcattagtgcatttccctcaaaaggaaaattattttataaatggctgatatacttgcctactataaatgatgcatggtattctagtttataaattgatctcctaggaaatcaggtgtttgttcccctaaacttgatcattccagagagcttttaggatcaattccttgaccagagaagagctttggcaactccaccgatgtaacggtgccttgtaggatcccacagaaagctgctaactagtttttttctttctgtgatgtacatttagctgtagcaggaaatagtgtgtaattagaagaggctcccaaaggttgaggccttatctggatgattgccaagtccaaactgcactttgtagacccaatctcagggagtccagtttcttccacagcaggacccacctactggctttagtttcatggttgtaacttctgcgaccccaagcttttaattctattcaaagcctcatcatctaaaagtcatttggaaaactaaagaatgacagctatcaactatatataagtggctttcaattcaaaagagggaggtgtaatataatgaagttaaattacattttgattctggttgctagatattctttgatcattaatggtgtcagcaaaattgagcacaccttaaagtcagacaacctcttccatgaaatgtttctctcctctccctttcagcctcacatccttccttcttctactttgtcacctcccactagataagcaacttggatatattgatgacgtcctcttatttgccaaaaattcaccaagctgttaataacttagatttatttatgaaaactacagcagatttaagtcaaccaacaggcccaagctctttaaattttttgttactagggtgacaattctacacccaattttagttttcaaaatctaggcagaaacacctttattgggatttagcaatgactttgttttataacctgcagagattattaggaagatacatatttcttcctcaccttctattttgttctatatttttgttaaaagttggcatatgagtacaaaaaggaaaacgttttttatgatcatctctgtctacataacagactgaaatttgtgagcatttaacacatttgtgccgaaaaatattgaaattataaaagtaccatttacaggcagccacctaccaactaaaacattactatggcattcttaccttccatcatgagcctccctatgaactgagtcacataggagaatctaaaaaaaaaatcctgggaggttcaaaaggtagccatttccctaacaatgagacatgtccataaagaagggcttcattatttttgattctcgtcaaatatttcaaggcattccgagagcccccatcttcagggttaaccacatgtagtatgctcaatacagccggtgtctaatacacagccaaacagtcgtctttccattaaaatgtgatttttgcttctgcttttccatctagcacatctgttcttctagcggttcttgtgtcgttagccgcctttccatcccaccttggcgctattcttttaattcaattgtgcgcaaattgcatcaggctgtcagggcttcgctttatgaatttccctttgaggacttgcacattcctctcggcacagaggtcggagccggtgggtgcccggctgccgccgccccgcgatcaatggcacctgaagcttccccgggcgaggccgtggctgcctggcttggtcccggagtccacggccacagagactggtgccttgaagacgtggtttttataaccatagaacgttgcatgccttattttaatggaaaaggtatctaacgaagtcggccgtaaagcaaaactccttaaataaatctgttcccccacccctaccatttccattataaaatcaaacaaacagtatcagcaagccgggaaaatacagagctttttatgtttgcacctcactttgttcccagcaggatttaaagtgatttgtaagcgtatgtaaaacaagagcatgtacatttaaaagtgaaaagggattaaaaactagggtggggacataaaatagagccaggacaaggcttaagtgatgcctaaaataacaacctctgctatgagtgggccacaatttggcactagattatctagtagttctctatcggctaatggcatcccccaaccccaactcaatttgtttatgagcatttttgatgggagatggagagatcagggtgagggtgaaaacgcaggcgtgtctggccaactcatttttcatttggcttcatgtaggagtcgattttaacataactggaaaagagaacatcctggactgtgcatccttaaagcaatcttcctcaaatattgctcttctgagacaaaggcgctcgtaaatattggaaggcattgaattcaaaatctaggcaggcttgccttgccaagaacagaaccgtaaagatgtatacagctgctctctctcctctccttcacaggcagacagctagaaagatgatctattcttgctgtcttagattcttaacttccccctcactctaaaaccatgcaaatctagcttccacccccaccacttcactgaagctgagcttgctgaggtccccaaagcacttttcagttattttacttgggtcctgacagcatttggacactgactgctcccttcttaaaatacctttgccttgggttttcctaacagcacacgttggtggctatcatctccctcttctctggtcatgccttctacatgtcctctgttgccttcttctgcacctgacccttcaatgttggttgggatgctgttctagtgctgagaaccctgtaccagaaagggtccacagaagtgtggccaccatacagaccggcaaaaaaaatctaattcctctgaatcccagagtgaagaatttcatgaagctcttgttaactgaataatggctgcagtagacgtggtatattggcttggtcgacctctattccaaactccttctggggtctttcacgtactgcagacactggagagctaggagctacatttcctgactgcctcgcagcaagagtttcaaatgtgatttagtcattattaatcagaggtattcctgtgaaatttgaatttgggactgagttcagtggagaaagaggcagcagtgcctgaggcatccatttagctggtgtgaagatctagcccatgtggctcgggggccaacaattctggtggtgccttcctgatacctggactgatagttagggtagtatattcataaatacagtatttttcctggcagtcagattcccctaataggcctatcaggaaaaattgtccaaggcttgaaattgggtcatagagatcgggagtgtctttcaggaaaattctgatatggtctggtagaaactttaggaattttctaattctataggggtatgcactggtgacttcctattaactaaactattttacaactctgtaaggtagaaatttatttgcagcaaactatagaaatccagatagttttgttttttactttttaattttatttgaatgtagcagaaacaggatctcattctgttgtccaggctggtctcaaactcctgagctcaagcaatcctcctgcctcggactcccaaagtgctggaattaccagcatgaccagccacaaataattcttatccatagcaaaacaaatcttttttttttggtagatataaaattgattttagccctgaagaaaagataattccaaacattattttttattgccctaaagctacattgtctaatatgaaagctactagctatgtagttattgaactcttataatgtggcaagtttgaattgagatgtcttataggtataaaatatacaccagatttcaaagactcgatatgaaaaagtatgtaaaaagatctcattgattttattatattgataacatcttgaaataattatatcttggatagagtgggttaaataagatattattaaaattaattttaactatttttacttcttaaaatgtgactcttagaaaatttaaattacagatgaggcttgcattatggttctgtcagacagtgctgtcctgtagaattttagccagttttgcatctattaaccagttgattgaaacatttctgattgtgtgtgtatatatgtatacacacacacacacacacacacacacacacgtgtatgtatctctgaattctcctttgaactggacttaacatcttacagattccctcattaattaatgtattaaataaaatatttgtgacatgtcattttatacttgcatgagaatcacagttctaacatttatactttagcagtcaattctgcagagttgctccaacaggcccaatctagatttgttattccagttcttgcaattattttgtaagtacctaattccctgtattaaattccatcctaaaatggctaaggtggttttagttacctgctactgcaccctgactataccctgacattagcttaaaattgaacatttactattttccagatactgtgttaaacactttacagattattttatttaatcgtcaccgcaactctgtgagggaggcagtatactcctcattttacagatgaggcactgagagtttaagaaacttctccaagacaaccaggaagtagtagctggactcacacctaagcatactgactctaaagtccacttccatccattaccactgtgccagcacctattctgttccaccaaataaaacagaaagaagggcatatctgtcactagatatgtgttgacctagaagctgcggtgcggcaaggaagttacaggttatagtcatcccctcacttgttctgccttctctactcctaggacctttgattcaattagctggttctcagaatcctgggcatagctcaagcctgagtggctcttccagactctcacccaactgaggaggttggatgatgcgccattttccgctgcaagctgagaagcacctctgccaagaccaagaggtctcactggtggagatgcactagaagtatgtgactctgagggtcacagagcttgctaaacaggctgtctaccatctttggcaaaggcaggaaacaattacactgtaataatagttattaatggccagatgttgcactaagtgatttacatacattctctctaatcctttcaatagctcagtggggtgagtagcagtatcatccttttaaaaatgaggaatcttaggtcttaggttaattatggatgctctaggatttcctggataatcactgaactcactaatcaagggctacatatctgacaaatatttcagacattaaaacatttgataataaaggagtctatggtattatttgtccacatgtaactgaataaagaaacttgttaaagaaaggagaatggcaaaaatgttatatattatccttccattattaatgctagtttaaaagcttgaaattgacaggcaactcagtattttccaacatgcatcacattagcttttaattcattatctgtctttattttttactgtctcctttcttgctatggtcttcattttatactggcgctgaagagacatctgaaaggattatgccaccccactttagtcccagggaatagaactactatgaattattgatagtgttagctttctagtgctttaatttcacctctgtttcagacaaggatattagttaaatggaattttttatatcaccccaggagcttactacacaggaaatactgactgacttgaattattgaaaagacagtcctatgttgatttccatttctacataggatggattcttcatacattccactcccctatatttttgcttagtgttaggttaatagggcagttttcaaatggagtccctcagaacccgcgggattcctcagagatgcttgcagtacaactggagaagcaagagggctcggtgggatggtatctgcaggtagacatacacatgagtgcacacatatgcccccaaccattgccttgcttcagagaaaaacttcacttgtctaccgtaagtattaagcctttgtgcaagattatgttggaagaaaggtttcttctcttcacaaatcttgaggctgtgtatggtggctcactcctgtaattgcagctcttgggaggctgaggtgtgagaagtgcttaaggccaggagtttgagaccagcctgagcaacatagtgagaccccatctctacaaaaaattaaaaaaaaaaattagccaggtgtggtggcacacatttatagtcccagctactctggaggctgaggcgggcggatcccctgagcccaggaggttgaggccacagtgagtcatgatcacaccactgcatttcagcctgggtgacagagtaagatcctgtctcttaaaaaaaaaaaagagtaaaatatcctgagttaatacaataaatacaatagatgtttgcacatctttgagatactaagaaaacatgtctaaggggttttatactatatagttgagtgtatacagctgtgcactggacttgacagaagctgatggcatgtcatatgactaggcttgcaggatggacttggccctcctgtggtattgtaagaattaccccgaattctgggtaaagccagttaccatgtatatttatgtaatgaataaactcacaagcgcaaaaaaatgcaataatattggggaatggcaccgataaatgaaccaattgcacaagtaaacttggttcacctgcttctattcgggtcattaggcccctgaatccataggcctccaatgttctttaagagaaggaatatagtcattgcttgtgttcttcagaagggactaccatgagtaaaatattttctgagtttctgtaataagagcaaatatttctctaacttgcaaagagtattttaaaatgtgagggttttgttttttgtgagttaatgagttaaaaagtagcattcagggttcctttctgtatgtggatggtataggtgcctagaaattgccctcctcccacgcatggaagctgtagacctgaagaaggtaggcagatgacaaaggctcattcattcagtatacatttatttcttcggggtcggggggtatttctttaagttttattttatttgtaattgacctatgattgtacatatttatgaatatgtatttattgagtacccactattaccaggcatcatgctaggtgttgggaatctaatagtaagacctatcctgccaccttcttttttgtgtgtgtgagacagagtatcactctgtcgcccaggctggagtgcagtggcgcgatctcggctcactgcaacctccgcctcccgggttcaagcaattctcgtacctcagcctcccacatagctggaattacaggcacccaccgccatgcctggctaatttttgtatttttagtagagacagagtttcaccatgttagccaggatggtctcgcattcctggcctcaagtgatctgccacttccacttcccaaagtgctcgaattacagcatgagccacagcacccagcctgatcctgccaccttcttagaatttgcattctgttgtggaggaggcatataataaacacatagacaatcacataaacatagcaattacagaatgtgatcgttgacatcatgcatgcaacagagtaggggtggggcccttttcacataggggcagtcaaagaggaggccctagaacagcagaaagctaagtgcattttagaaggccacagctggcctctctgctggcttccaaagcaataaatgcgtggtgcttactgtatttgatggctaaatacatgccatctgtactcaagaattagaatgctgtggaaactctgaggggaccaatagttggtgacttcttgtataggaacaaaaaatatggcacagttaatttattacacaaatagatttttccttagttatttaacatttatcagcactgtgttttatttatttcttaacgcaaaggtgggctgagggataattaaaagtaatatacccaagatcattgtccttttccattccataaaaaaattgtctccaccactgtttatgatcctcatcaaacatataaaaaatgcatccataatgaaatctcctcttatattgttactttataactgttaaaggcaacatgatttttgtaaaggataaaatagactacaaaaattagtttcattttcaaaacctctacataagcatgtaaaatatattagagtgaagagggacacatggttatcaaataacctgacttctatcaacagaagtttccagtttacattattattctttcatttttactagatgaaccttcttttttgtttttataagcttatcagtggatcacccttcttaaatagaaatacctggaagatatatgcacacaaaactgattcagatttaccgcagaaatactagatttcaatgggacattcaagcaaatataattcatccatctacccatccatccattcaatatttattgagtaagctaaactaataggtaaaatatgctggaaccagagcagtgtattgtggttgtgttggctccttgggtgggtgaaacacttttcctgtttttttttttcattcttttgcacacttactgtagaaattttctgaaaggcaagtagtcaaactgactggatagcctaagaaatttgaaattatctggccgagtgcagtggctcacacctgtaatcctaacactttaggaggccaaggtgggaggatcacttgagcccaggagtttaagaccagcctgggcaacatactgagactccatctccacacacaaaaaaatttttaattagccaggcatggtggctcattcctgtagtcccagatacttgagaggctgagatgggaggatagctgaagctcaggagttcgagattacagtgcactattattgtgccactgcattccaacctgggtgacaaagtgagacccccatctcaacaacaaaaaatgaacaaacaaaaaaattatccagtccagccaatgtgataaaatggactaacagaatgaatttggggaaaataattcaggaaaaatacatggagtggtttactggcaaccccaagaaaaagagaaactattatactactaaaggagttcagtaaggcatctgattacaatacaagaaattactagttttcctgtatcttgtttaaaaacataatgattaaaaagcatcttgttcaaaatagcaagaaaaatataagagtataaatttatcaagaaatatacaggacctgaattaaacaaactataaaattttagtgagaaacttaaagacttgagcaaaactggagaaaattttcactcttgaggacaagctgaaatgttagaattgccacttttctccaaattatttttagatttaaaaggggatgtgaaaggactggatgaaattatgctaaactctaatagaatgtatgacacaaacacggacatttaaaactagaagaataatgaggtggcggtatagggactaatggacattaaaatatattctaaaactataataattagaatagtttggtactggttttatattctaaaaccataataattagaatagtttggtactggtttagggattaagtaaatatatcaatggtgccaaatagaatgcctataaacagactcaggcatatgcacaaatttagtgtaacagttacatttggaatctgtagaaaaggataaattatttagtaaaagatgcaggaggaaatgtctattcaaaattaagacatctttttcatataaggcaatcacataattccagatttatgaaagatttaaatataaaggataaagccatacttttatatgaagatggcatattttgaacgcatgcatttgcctctgctccctcctcaaccctacttaagtatcagtaaaaatgatttttaaaaacccttaaaaacacccacaaggacaaataacgggagataaagctacagcaataaaaccttggaaactagaaagcagatgagcgggtggtaatgcaaatttgattgtaagcattgcaggctaccaaagcagagaaatggtccagttaacacagtggaaatccctcaaggctcaggctactggaagtgggcatgaaggtggggctaaaaataaaagcactgattccaaatctgcttactaagcagttgtgccccatgtcacacaggagagcagctgccctgtctgctcaggcagaagccagagttcatttgttttgagacagtcttactcactctgtcgcctaggctggagtgcagtggtgtgatctcggctcattgcaacctctgcctcccaggttgaagcgattctcttgcctcagcctcctgagtagctggacttaacggtgcacaccaccatgcccagctactttttttattttttggcagagatggggtttcactgtgttggccaggctggtcttgaactcctgacctcaactgatccacccacctcagcctcccaaagtgctgggattacaggtgtgagccactgcacccagccagagtttcacttttatagacacagttgaaaaaatgatgtagtgctgaagacagggattcagtgaaagttaatccctggaatgttgaggccttaaccttcttcccagatttttaaagcacacataaccagactcatagcttctaggcaggaaatagggtgtatcttccctggagaatatgaccagtccaaggaaaaagatatcaagataccaacgtcagaggctcccagatgcaatggtcaccctagaaaacctaagactggccgggcacggtggctcatgcctgtaatcccagcactttgggaggccgaggcgggcagatcacgaggtcaggagtttgagagcggcctgaccaacacagtgaaaccctatctctactaaaaatacaaaaattagctgggcacggtggcgcatgcctgtaatcccagttactcaggaggctgaggtgggagaattgcttgaacttgggaggcggagattgcagtaagcccagattgcgccgtggtactccagcctgggcgacagagcgagactctgtctcaaaaaaaaaaaaaaaaagaaaagaaaaaaaagaaaacctaagaccacagctcagcagtagggcaaaagagaaatccattgcagattggtggatggggaggctcacactccttcacccactccgggaaacatctgactgaattgttaaatctgccctctgaaatggattgttcctgctgaaaaaaactctggcccaggcattgatcccaggccccagtggtttggaccctgcttgcaggacaggcacctgaagagcacactgcattgcaggcaggtgtgtttgcaggtccctggccatctagactaactttaagggtcctcaatgctctttcacaattcctttaacatttgtcaactcctttagtgattattacaccttttcactttattcaatccctcaactcttcctccaccccacttattctcattaaattaccttacctccctcacactgagaaaatgaaagctatctcatgtgaatgcctctccctatccaaattgctctccaatttttaaaatccactgtcttctcttccatacagagaaaatatgtcctcttttctatacctaatgagtccactcatctcttgatcctgtttcttctgacagctctgggccttgttccatcaattaccactcctttgctcgaatcttcaattcattccctttgcctacttatgagagtatgtgtagtggacactgatctaccactcagattccctttcaagattgaaggattcagtcccccagaagccaggaatgctgctggaagatggcccttagccatcagccttcttcaggaattgcctcagcagaagaaagtcacctcactagagttcatgtattcttccctgggcagctctcctctaacaactgggttaatgtggggaatataaagaccagccctctcaccttgagacaactgtgaagggtcttcccagtttcagagctccttaagtcttggctaaggtcttcattgagactgcatcattgcccagcttctcccttagtccaatcttgtctcctttcctttcctcgctttccacaaattgttaaatgtgacagcactccctaattaacttcctgcatgctaatcatctcagagcctgtatcccagggtaccctccttatgacagtatgtttgtaagacaaggacttttaataatttgttaggtagtaccaagttgccctttcaaaaagctgtacaattttgcactcccattaccaatgtagaaaagtgcctcttttcctacaccctaattgccactactggatattatcaagcttttaaatcttcccattccataagtgacagatggtggcttattcttgctttatttgtatttttaaaaattatgagtatgagtgagaatgtttttacacattacttactggctatttatattcctttccctttcatttgcttgtgttatttgcccatttttctattgcacggccatacatattggtaatataccatatgccatacgtatattaattttcaagtaccatttgtatagtaagaaagttgcaaataagttgtttcagtttgctgtttgtttggctttaagactttcttctggccattcaaatgttttgcattttttaaatttgctaacattaccaacatttttcctgtgcttcttggttttctgtcaggcttaaattggcatttcccattctaagatttggggaaaaaaaccaaaacactaatgtcttccttaaaacttagctcaaatgtcattgctctcacaaagatgtctctgagtaccttgaccagagttaaccccccaattcccttctccctttatataatataaatcacattgcctatcatattctgccttaacattatggccatttttattattttccaaactcttctattggaatgtaagttactgaggaaaggaattccattttaaatctctatgtatgccctccagtatctagaatgacttgcgtaaagtcctacttaaatatttactgaattgtaataactagtactgtttgattatgtggctctgacactaagggtgagtgattttatatatatgtatacatacacacgtgtttgtatatgtatacatatacacgtacatacatatatttcacactctttctcattagacataaattttgtgaaattttgtgactatttttttgcttggagaactcttagttctgccatctttagacctcagccacacttaccaaagactgactgcaaaaacagcacttgagagtcaggtctcagggcctgccaagtgacaggtgaccagaacactcctagctgaggaggcagatcaggcagggtggttcctagcaacaggggaagcatatatggagccatgacacaaagtggccatcctccccacagggtaaacagagctcagtctcccaacaccatgaccatctgccccatcagtggcatagattcctcccaggccatacttttggctggggaagaagtccctgatgatgttgaggacaagatacaggcaggtatctcaactaggtcaatacattgagttatcagctcaggtggattagtcgttgcccagttcctatgcccagtagccctagtcttggattccatggtttcaatttctcccttttcattctcttgagcccattcaaatatggttttcatgccaccacaactgctcctgctcctgccaaagtcacaggtgacatcgacgttgctaaacacaatggccagttctcatttctcacctcactggccctgccagcagcattggcctggtggatccctctctacttcctgagggcttgattgggctccctgggcaccagtttttcctcatacctcactggatgcttccttctctgcctttcctggttcttcctctgcttcctgagcacttcacattggagaacccccaaagtacagtcattggacctatcttttctatctagattcattttcttgatgatcccagccaatcttataactttcgatactgtctatctgctgacaaattccaaattttatatcctctaaccagactcataggtccaactgcctactcaccatctcgctttggatgtctaacagacatctcaaatgtaacattccaaaactgagcctctgatcttccccttcccccaaaatctgctcctctcacagtctctccatttcagtaaatgacaaccctatccaactagttactcacaccaaaaactctggtgtcatccttcactcctctccttttctcacacccacattcaatctgtcagcaaatctacttttactataccttcaaaatatactcagaatctgaatcctcctgacaaccactctgctaaccaccctgtgcaagttactatctcttaagtgtctctcttttctcatcaataactgggggcaataatagcctatgacttacagggttcttgtgtggaataaaagataagacatgtaaagaacttagcatagtgccgaacaaattgttagtgcttggccagtcatggtggctcacacctgtcatccaagcactttgggaggctgaggagggaggattgcttgaggccaggagaccagcctaggcaacatggtgagatcttgtctctactaaaattcaaaaaaattagccaggtgtgatggtgcgtgcctgtagtcccagctacctggggtactgaggctggtggattacttgagccctgaaggtcaaggctgcagtgagccatgatcatgccactgcactccagcctgggtgacagagtgagaccctgtctgcaccctcccccctccaaaaaaaaagttgttagtgcttaataaattttagctttcattattatttgtggcgtcagttttctaggaggtttcaagaagacgtggctagtaaagttgaagctatcagttccttttcataagaactgagttttttcttcaacacatgaaattttcattttaaaggttttacctaaatgagctaaagagaaagaagtccaaactaatctcacccagtaaaactgtcacagataagatccaaataaagggttaaaaagcacaatagcaatttgaatcattggaattcttctctataaaagtaattttcagctaacctagaaaatattttaaatctaaagttatataagattgtcacatatcatactgcatagctgtctacagccctagcttcacaacctgaaataatttggggatatgaggaaactcataggatgtttctacaacagcaactgagataacagccatcatttgtataaaacagccttgttttataaacctaaagtcccagctaattagtaataggtagaaagattctggaaaatcctcagtgttatctgagatgtcagcaatatacaataggcctgaactatataggaaatatcttgggtaagtgacctaatgcataaattagatgtgtggatatcactaataagataaaccattgcactaaataagaagaaaaatatttcagagcattcaacttgtcctttaatgcaatcactttgttaatatatgtggtaagaaacagtatttgaatagataaaagtagatgagcattttttcttaatatttttcaaaaattatgtttcttctttattctttaagtatggatctctttcattatatatatgtctgtgtgtgtgtgtgtgtgtgtgtgtgtgtagagatatatgtatctctctatatacacataaatacatgaaacatctaccacgtgctgagtaatgaggaaacaatagtgaattgtttttattactaagctccttataaaaatattttgatcgttttgagtataagagccaggtaacagtggccttggagtgttttaagttggcgggtgggggagataaccctaatataaaatcatcaggaattgactgtgcttaatttattagattttcttcatctgtatttaattatacattatactctgtggtattcttagagtgatatatacaatgtaaacaaatttaaatatcacatatatgcaaaaattacttagtaaaggtaaactcccattaatacctactgtgggctcattttagctgatccatgtatactttgtatgctaattttatttatttatctgtttttttataggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaaaattctggttaatgtgaacattatttggttggagctactttaatgccttctatattgttgtgtgcagtgaacattcaggctgaatgatggtggctaacaagaactcgcaatttcagtatagcaagcagcaagattttcaaccaccacccacaatagatgtcctattaaccagaaaagaaaccgagagtctaaatgaatccatacaatactgtcccctaaacttggcctatctcttgggaagcttcacatgtaactgataaagcaatggagaatttaaaggggaaggttttttctatagcataaaatgataatgttaaaaaaggaagacctttaatgaaaaacactggggaatttcaagtgttgtaggcatatacttgcacatattccatgattttcaaactttttatatcaatggaatccttccttaaaccaaaattttatatagaattgaatacgtaagtttttaaaaaaagcaaaaacaaagcacagctggtgaaaataaagtggagatgggcgtccccagagccttgcatacttggtgtccctttctctacttggacagtttcaaataccttgctagtacactttgaaaactactattctatctaaggaacaaatctctattgctatcctccatggcctggagaacgaatgcaggcctctttctcttctacctatgcaagataagaaatgaggagagatgaagggggcgggggtgagtttgttcattggaaaggttaactccttgatgataatattgttatcaaatgtatataaaacaacacaacattagggaatgactttccaaataaaggactaaagaactttcctattattctaataccatcatcatgttaagtattacatgtttcaaatgtcacgcaggagaagctattgagatgttcttttggattttgctctccttctgtttccccactcctgattcaagaaaggttgacaagtctttgtgttcccttatttcaggggaagctttgggtgccagatccccctgaagacaacctttcttccaaaatttcattttaaagagggcattatcctgtgagttgaggagaaagacaaatgctgggcttttagggggtaaaagagaagcagaagttgtgagagccaaagaagacaaggagattatccaagactttggaaaggaaccaaaggctgtggattacccaagtcatggagacctgcacctttctccccagtggcacctctacctatagctaaacctgaaagggaagcagctgtagttcccagagaagctagatcccaggcccaggggcttccagcattagcaggattcctgtccccaaaaatgcttcaaagcatcctacaaacaccagggtggttacaagggaccatggtggtttgaacagtgatcatagcaattggtatgcgctggacaccgagaggtatttccttaatgttttctctgcatataaccctttgcatgctgcttctgagagagggaacaaagcaccagggatgactaagatatccacctccagacaggatgaggcttgaagcaggctcgctttgatttggagaaaataaaatagacatttttttcacccacaagtttgaaaacaaaacctctatctctccacacatagaaaggctaagtgattgaaaaaaatgtatgatctcagaagtgacaccaatatgttacttcttattatcctgatatcctttggtagctcccttcccagctttcttcataagaaaatcacacttcactagaacaatcttctaactgcacaaagtgaatcacactagtcaagattgcttaatgattagtacataactaaattctattacttgatgaaaaatgtagataatgattgaaaaataggtgttcaggagtgggtagaaagcaagagaaatcaggataaagcaatataaaaatatgttatggggaccaggtaacacatctcaacggtaaacttgtcaaatttcatgttgaatttacacagtgaatttttaatttacatacattttaggtaacaaattttgatacatttatttgtatcagaattagacattttagaaaccaagaaaaaattaagcaaaaactggatacctacatttcagtgactatcaacctgcgatctcaacactccatgtgcccatgctgttcccctcaagatgcaacatatcagaattaggggagaagtgtgatttctaaaatcatattatttttcacacttatacaaaaatatctatctttttgtttttgagacagggtcttgctctgttgcccaggctggagtgcagtggcatgatatttgttcactgcagcctcgacttcctggactcaagtgatcctctcacctctgcctcccaagaagctaggactacaggtgcatgccaccacactggctaattttttttgtagagacgaggtctcactatgttgcccaggctggtctcaaactcctagactcgagcgatccccctgcctcagccttccaaagtgctgggattacaggcgctcagtgagccactaccgtgcccggccttttttttttttttttttttttttttttttgagacagtctcgctctgttgccaggctggagtgcagtggtgtgatctcggctcactgcaacctccaactcccgggttcaagcgcttctcctgcctcagtctcccaagtagctgggactatgcgcaccaccatgcccagctaatttttgtatttttagtagagatgaggtttcaccatgttggccaggatggtctcgatctcttgaccttgtgatccacccacctcggtctcccaaagtgctgggattacaggcgtgagccactgcgcctggccaacatgctgattttttaaactcaggaagttcagtagaatctccttggctggagagaatgtgaaaaaaaaaaaaaaggctctttactggtggggcacataggaacaacggtggtgtaggaggaacgacaggggtgtaggagagaagtgagatttttatctgaggaagggtgtgggcctctcaggttgaggagaagcaatgcaagtttcatctggtagtgggaatctttaagttcagagagtaccctcatgcctgaagaatgcggcatagcacctcacggtagaagggcagaaaacactgaagaaggcacgaacaggcagtgggtggagacaggcagcagtatcggttagtttgactttgctgcaagctggtcactattttttatgactaagtatttttaactttgtctactgaaggaatttttcaaaagcatatatcagtaaactcataattagggacaacagaaaaacagaattcacttcaaaaaattagcttgtatttgaaagtatacaggccacaaatgtatttatacagtaactctccttggtttctgttgataaaaaaatgttctctatttggttaaaaggaaacattttaatgtctggaactaatttcaggagctgaaaacaggcagcatggtatagtagacaatgctctgctctaggaagaagacctgcattctggcccaggccatccaccgattacctgtgtgtctcagtttcctcaactgcaaagtcaagaagttagactaaatcaggattttgtacaggattccactgagccacaggacttccacggggtggtactaggaggactacagaaaggcagtcagaaagagaggcaatttgaccttggcccagggccctgatccctgctctaatcagagcagctccacccccatctcttccatacattaggattgtccataagacatctttggagaagaattctgcctcaaagaaataaaaaaaaaaaaaaacacaaagacactgaatttagatctagggtcttcttttctaaatgtctataaatgctaaactcaaatgcagttcctattctcttgattacttctgtcaagcccatgtggtatgtatacttaaccttaagctatttctgttgaaaacatgcataattcatgaaaagtactattggaaaaaaattcttcttcataatggcttccataaaggtgcacggtggctaaggtggttaaaatctgttttgttttgttttttgtctgtcacccaagctggagtacagtgacatagtaagggctcactgcagcctcaacctcctgggctcaaatagccctcctgcctaagcctcctgagtagctgggactacaggtgccaccagtaatccagcctacttctttttaagtttttttgtagagacagtgtcttgctatgttgcccaggctggtctcaaactcctggcctcaagcaattctcctgtcttggcttcccaaagtgctgggattataggtatgagctgccatgccctgtcagctaaaatatttctgaaattaattttctgttgtctttcattcctattcttatcttactgtgatttaaaaaagtgcaagaggaaatacacatatataatttgtgggttaattaaaaagtgtttttataagcatgtcttggagatgttaacctaacatttagaatcatacataagaactacttttctttttcttaactggttcaaatggttttgaataaaactgacatctgaaaaaattttaaattttagaattaaaaattctagtcactgtgtgatctctttagctggtttttctatagaaatagggtgttttttatttgccttttagagagcctgacttatgctttattctctgctggaaatatcagtatacatttttggttggatgttcaaggtccttctttcatcctcaaactacatttttctttgattagtgttattttccatgttggcaaaatggactttgcaagtagcagtgaatacaagcctgtagtatagctttttctctctcattcccattttctacaaaaattagaagacacctagagaaaatgagaaggtgcaggagatttattgtattgaaaatttagtgttatttcaaaacaattataaagagcaagaatcatagtcatttcatcatttgttaacatcaaggcagaatttctaccaaattcagtgcagattaatctgcattaaaaatatgcctgcaacggttaaccaggacactgacaaagtgagcagacactgcgtaatattacatcaaccagaaaaaaaaaatggagcagaaatcattctactcctcagggatgattttctgaggcagcaaaagaagaatcaaccattctctcttttcccacatcccaactacccctccttctccactgagtgggctaacatgactcataagtcacagcacataggaatgagaaggtcacaggtactggcatagcgggtagtcccttttttcaaagcatggaactggaggcaaagaaaagagcctcagtggcagagcatgctagaaattgcattgagagatgctaacagcaataacagaactataaacaaaagcaagggggtgattatcacaaaacaaggataatggttattctgggttaggggaaaggggttgtgttccaggacaggtacatgaaggcttcctcaactagctggtggtcttacttttctccacttgaatggtagctccataggggttcactttataattatttaaactctacaaaatattttatacattttttgtatgtgtatttcatagttttttttaaacaaatgttaaggctcctagaaatttcatagcaaaaaaaaaaaaaaaaaaaaaaaaaaaaaaaaaaccctaaacactggattacagtagatagaccattctaaggtgttagacctgaggaatactctctattggcaaatgtcagtgtatcaccagtctcctcattaaaaaatgaagaaacaggaaacaaaagccagccttgcaattcacaaaaagcgctatacagcccaaggtaaagggtgcattatgttttaaaatcagaggaagtacatacctctaaaaattactacacaaaaaatatttcaggaaacacctgctgatgtccattgtatatcctgaaatgcatacaataaaagttgatctctgtgaaacaagagaaggcagcctttagaaagaaaacgtgcaggttaaaataaaatataaagatgaaggaatattagctgagatgtaaagatcatagtctgaagaacaggcaacacacacacacacttaaagacaaactgtggaaaatactaaagagaacagaattacaacccattctggaattagcaactgataaattgaattagtgtatatagagctgtggctgccaaacccagctggtttcagaattatctggggagcattttaaatatacttcttaccaaaccccaccctagacctaatgaataaggatcctccatgatttttgtctctaaatctaaatgttattttttttttaaaaaaaaagccccaaatgactttgacaatcaggcaggcttagaaaacaatggtgtcgagaataaattttaaaagctcatcaggagagtagatgaaggaacaagaaataaaagtgtgagaggagataatttggaagacagagtacatatctaaagcaccaataaatcaatgatagaagttcctggggaaaaagtcaggataactgaaacagaaggaaaaaccagctatgacagaagagaaattttcttgagttaaagtatatggccgcaaggctgggcacggtggcttatgcctgaatcccaacactttgggaggctgagacgcgtggctcacctgaggtcaggagttcaagaccagcctggccaatgtggtgaaaccccgtctctactaaaaatataaaaattagctgggcatggaggtgggagcctttagtcccagctacccaggaggccaggtcaggagaatggcttgaacctgggaggtggagattgcagtgagctgagatcgtgccactgcactccaggctgggcgacagaacaagacttcatctcaagaaacaaaacaaaagaaaaataaagtatatggccataaagtaaacagtacagtattaaattatacagtataaacaaaaatgctctaggcattccacctcaagaggaacctaacttctgcccagtaactttctctaatccattcactccctgcccttttagactgccatttcatgcttgctcctcactcctcaaatctccataccctctccttgactcgacgtgaccttactttctacttccatccgaaagaacttccatgagcaccgagcattgcatctacccacctacctccatctgtacctcagttcttcctctaccatcttattaccatagatgaattatttatgatcctaattaaggcaatgcctggatcccataacctcaaggactctgctccagcagtctccccatcactcctccatcatcagtttttgtttcctactgaatgcctctctcccctcaaacatgctattatttctccgtgtcttggcccatctggctacggcgacatatttcttcttttacagatgaaatcctcaaaaaagctgtctacacttgctgtggtgtaactcctccattctccttgaacctgtttcccatcatgcttttgctctcccacacccaccagtctaccagcttcctcttccctaacaatttcatttcacggctgctaactccgctgaccagttgtctgtcctcctcttacttaaacctatcagcacttttttcacttggcttcttggacatcacactttcttggggttccgctttcctcagtattcgcatctttttagtcttttctggtgatttctcctcatctctaacttcgtaatgttggagagccacagagctcaggctccagacatgctctctccttcacctatactcatgcctttggcaatattatccacctcataactttaaataccacgtgcatattgacaaccctaaactttacttctaccacttaagcttattctctcgactccagattcatttaaccaacaccgtactcaacatttccaattgaacatctaataggcatctcaaatttcaatgttctaaactatggcgcacttccctcctaagctgatggcccctcccacagacctcgctgagtaacggcccgtgacagcccacctcagctgatggcccctcccacaatcttcccacctcagctaatggtccctcctgctgccccccacctcagctgacggcccctcccacaatcttcccacctcagctgacggaccctcccacagtcttccaccctcagctgatggcccctcccacagacttctccacttcagtttattgtgaacaccccaacttttgagatgttcaaggcaaaaattttgaaggtatctttacctttctcttgcattcatgcccctgttgtctctatcttcaaatgtccaggatttgcttaaaagtaatccagtggggtagggggaagagttgggaggagaacgggagggaagatagatggaggtatagatgaaacaagattgaacatgagttgacaactcatgttctaaagtgggtacatggggattcattagactattccctattcttttatgttaatatttttataatacaaagttatgctgactctaaccatttctgattacctctaaggtggcagcactgaccccatcaccatcattactgtcacagccttctaactaaaccccttgcctctgcctctgcccttcttccgtctattcaacacagcacacatgtgatgctgttaaaacagaaaccagatcatgccacaccccagctcaaaaccttctcagtgcaatctattttactctcagtaaaagccaaaatcattacaatggcctaccaggccatgcacaatctggcctccccttatgtctttggccccatctccttctactctctctcttgctgactctgctccagccacatggaaatccttgtccttccttgaccatctcaagcaagctctgctcttaggcctttccacttatttttttctctcacttacatgctcttctcccggatatccacagatatcactcctccacttccttctggtctttgggtgaatgtcactttatcagcaagtcctgccctgatcaccctatttaaattgtcaaacatatactccccaaactccctatctacttttctcctttagtttctccatggtacatatcatcatctgatgaatatgttttacttctttgtctttcattccaacgtaagctacactgcggcagaaatttttataagagtgcaccttgctacatctgtaacactggtaacagtgcatgagcatagggaatgatcattagtatttgttgaattaaataaaagaaatattcctccaagagcttaagctaagatgacagaagtcagaccccatattcatgataaattagcaatggttaaagttatcctataataattcctcacataatccaagcatatgctgattacaataaacagatttgaaagtgacaaaaatgactatcatccataatatagtgacaaaccctggacttaatcttctatggtaaataactagaatgttcaacaaaatacatggaacaattgtttttggacacaggacaacagctagcgcaagactgcggtccttgagaaaagggaaacaaaataaagagccctacaattgccctagttttctggatacaggcaatttccaaacggcaggagcaggaaaggagaattaaaacagtgcctccaaactgcaggagcaagaaaggagaatccaaacagtgcctggagatgttgctgaagagacagaaaatggtgtttaaagagacaatggcagctgaaaattgccggttagaatgccagaaggaaagaagctacacagaaaaaaaaagcttcagaaatatacacaggggttcttttgagtctttcctgcgtattagccatgcgtatgtagactgaaattccacaaagttgtgcaaagaatgcctggagaactgtaaaaagaagaaaatctcacagctaacatggagctaagagaagttcaagccagaagtagatagtgctcagtgaccattctagatccaccctaggaaagatgaaaaatagcactttaaggtatcatactgattaattggtaactgctggccaaaacaaagcacaacattctttacagaaagatttttttaaaatctggattctaaagaatattaaaagtatctagcgttaaatttctgaatgaaaaaactgaaaactagcaatgtagaattctatatccattgagatatgaaaatgaagacaaaatttaaactttatcagataaaccaaatttggaaaaaattgtcagcagagctgcacaagaaatgttatatgaagttctttcaattgaggggaaatgacaccagatggaaactcagatttacgtaaagaaataaagagtactagaaagggtacatatgggaataaattaagaagacattttcttctcattaaagaaaatttaagacagtagactcctcacaacaaaaataacagccatttattgatgggcttataatacatacaaaagcagtatgcatgacaataatactgcaaatgatacgagggagaaatctaagtattctgtgtaagggtcttgcactatacataaagtagtataatttgaaggtagactataagttaaatttccacattgtaagccttagagcaatgacttttaaaaaagctatgttctatatctggatttaggtgaagtttacacaggtaggtgtgtgagtttgtgtggatacacatatatatttgtcaaaattcattaacttataatcttaaaataggtacattttattgtatgtgaattctacctcaataatgtttgatttttttttttttgaagtggtcaggcagatttgaaaaagaaccaaataaaatgttttaaatgtttcaaaaaacataaatgctaaagttataaacttagacatcatgttaaacagtagattagatacagccaaagagaatattagtgagctgaaaacaaatttatgaaaattgccaaaatactatataaacactgaaaaattgaaagaaagtagagacacagaagatagaaggaaaagtcttaaaaatgtcttatcaaattctaagaattaaagggaagaaagaggataagtaatcatggtgatgacagaaaattctgcaaaactgacccaaaaaactagagtctacacagagagcacaacatattccaagacaacacttttaaaattcatgaacatgttataataaaattgtagagtttaaataacaaaggtgaaatatttaaaagcagccagagagaaaagatagatcaccaaacagcaattggttttatagctgactgttcaacagcaacaatggaagccagaaaaaagtggaataatatcttcaagatcttaatatagagtaactatcaaccagaactgtctttttaaaatgagagagaaaaaaagaatgaagacatttttggcaaaccaaaatctggtattataagcctgtgtattttgagaaaaagcagaaaacaaaagtgtgtatatgtgagtcttcatggaaactatatatagttttactctctgcagctttttgcatatagttttgtgtgtacatgtagtgttacatatatgcataaaaatgtatattacataggatatagaatacatagaaagaattccatatatgtacatagaattatgtttcatatggatatagtctaggtataagtatacctctaaatagctctaccaatagagctttctgtaataataaaaaatgttttatatttgggctaataccattgccactagccacaggtggctattaagcccttgaaatgtgaccgaaatttttcgttgtatttaattttaattaatttaaacataaacagttgcatgtggctagtgactacaatataagaaagcacagctatagactgatggtgggaaatggaagcaaatccattgaaattggatggtgattgtctccaactggtagaattttgctttatatctatctgtatttatgcattccttttataatatgaaaaagcttatttaaaattatgcattatatttctaattcctaatttgaaataagtcgtgattttaccagaaaattttagaattaaactttaatggtgtagaaactgaattagcacttaatccttatagtgtttatctctggatatttttatgccaacaaagagtcttgcaacggaaacttcattttttttaagttcttttttctttttttggtagagaagaggcatgttgtccaggctaatctcaaactcctggcttcaagccatcctcctgcctcagcctaccaaggcatgagacaccacacccagccagaaacctcattttcatttaagtaaatcagctttgagttttcacattagaataaaatcagtagtttctttacaacaatatttcttttgcactgtgatggatctagataggattatttgtaaaaaatgcaagaaaagatattctatctcagagacatcatggatttatactctgaaaatataaaaataagttaaaatgttgaaactttcactcattcatctaattgtatatcataattttaaaaaagacatctttgggtttgtggttgcatacaatttaacaaatattttaataaagtagaaaataaaattaatggttgagatgaagaaaggatttaatattagattattaagaaattgggaggacacactataaattcttccagtttgcctctgacctccttaccatccctctcccataccaatttgcttgaatttagcaagagtaagaattatcttaatgggtcccattagtgcctacaatatgcagtctgcataatacatttgagacatcagcattctggtatttaggctgtagcttaactcggattttaaaaagaatgccaatgttccattcattgtttcacccattgtttgaaaacagagtggggaaaaaaaatgagctattttcaaatgtcagcaaaccctggtaactgtaaatgttcagagctgtcaatccatggcacatcacagaggtttaattcagcagtacgtgtataagcaagtatcactgccagccatgagttcagactactaatacaagtttaatttctactctgcacatcctttagtactacaagtatcactacatttaaaaaattcaccatatgcaaggacaaaacttgggtatgttaaagctctcttcattcgattacatttcaaagtatcactctgagatattacaaaacagatcattttcatgataatcatgtttttccaaaccataacatgcattgttttttaagtggaagacttaaatgctagctgtccttaagtagcccacaatttgactgagacacaagatagtcacaaacacacatctagagtaaaattctaaggtaataaacaaatgatgccatggtactataatctgtgtggtgttaaccctaaaattaagggtcaatattgtgtgttgccttgacatctggcttgattgggagggcctcaaatggttttcctgaagttcccttgcccccaactctgttcccatgaaaaaggttccctacccaaacaaccctccctgcttatcactaaattcagttccttaccagccgacagaattatttaaataagccaatcacgtccttgggcgaaaagtgcgggtcatcccattttcttgataccacacagcctgcttcccacagcctctggttcctcattctcttttctagtgcaatccccacgtggccctgcatggcatggcgtcctcttgtccttggctgttagtatgcgtgactaataaactgctgccaatcacatctgttcagtgtcagatgtcatgagtttaaccattcccctaatgctagggcaggaatctctccatcatcagcagggtgaatagggggtgattaaaacaggatgtacctcataatactgtaagaagtgtagttttagaaaaagacccttatgatggctgtctgaaaaggttttgtgaaagaggttggtctggatggagattagtattaggatcttacttctgggattctctgctgaaggagcatatagacaagaaatgatgacaaaatagtcaacaaaacactgatttcattagctagacaaagacccattgcaataataaaaactttagtaaaaactagattacagaaattgatttaggataggaggccaaagtgaactctcttatttcttatactctctgccttgaagtctataccctccctccaaacagttgcatgattatggatgactggtccatcagctccaaggtgcaggtaggacagagagagttgagatgaggaagccagctaaggcaggccctgcctgcttcatgcaaaccctggacacaggaagtgagaaagggcaaggttgtataccatccctgagcacagactttaatacaacgaacgtggtcccaatcaaaatcttcttctaacaatctgattagcaagttcgttctccagcggaatgaaagtgggtaaagagaaggatgccagaaatgaagtgacagtttccttctaatccatgaactaaggcaaaaataactccattccccacaaataggacagaatatattccagcaaagttaattagatcaacaaacagagtaaaacagaaatgaggaatgtctgtggaaaaccaaagtacagtttggagcaaggaatccaaattgtggaggtgtgaaaccaatggaaccagtgttaagatattcatatttttttgagtgtgtgaaatccaaagccagaaaagagctaaacaaccacccaagaaaagaacatgaagtctcatcaaaaagatgaaatcttttttgcctatcaccaacgtctcaggataccctaggtaagtccagtctctgacactcgtaacttccagtgaacaattccagaagcagggggataccagtgggctggagaggaagagaggggtctgtataaaacttaatgagatgcttttgccattcattcaggaaatatctactgagaatccgccaggtaccaggtactatgcgtggggctaggcaaaacagagaggagtaaagacaatctcaacttctaaaacacttatattctgatgaaaatactgatggataagaagtcaatgagcacttgctatgtgccagacagtatactatggaccaccttatttttactctcacgaaaactctgtgaggaaggcaggtgctataattattattttatagataaggaaatatcagaaagatacaacttgctcaaggtcatgcagcaaagaagcggctccaactccagagcccagcttgtaactattatgctatatagtccttcaaatagtgaatgagaagcgaagagaatattcacaataggaaggaaaattcaggtctatctatattcagttcagaaaaaaagacaaagaatctaagtttaaaaatgttcatagagaaggtaaaaataaaaagtttaaagagtagtagccagaagaagtaacataagcctcacgttactatataagaatataaagtgatagaagataataagcttggaatataaccccatgaaatacacccaagataaatttaagtaacttaagtttctactacttaagtaacttcaagcattcattaggaaaataacatacttagaatcattatattttacactagtgagtttttctgctctcatccaaattaatcaaaccacaatcaagttaaagtacaagtctcaaattagttatgtggtcctatcttctacattatttgggctcatgtttagagagacagatacgagtttggaatagctgatctcatgagtgggcttctcagcctaatattcttacagaaatgaaatctggtttaaaataaggattaatagcaggctcagcaaacaaacagaatctaaaatataaacaaaaaagcaagggcaagcaacagttttgcagggaggctattaccaaagtgcatgctgatggaaaccacagtttacacaccagaagttgtctccttctgtgaaactaatcccaagagggtggggttaggacattagcgtagccagctattggatttcctaatgatgatgtctcccacttgttaagcaagttctttcgtgtgtaactgctccttcaagcttgctaggtaggtagggtaaatggtagcatcccagtctacagataaagacagaggctcagagaggtcagatttgctgactgtctcagggatgataaacaaaaaagccagccccaaatctggatttccaacaggagaatctcctgcccttgttcactgtggtggcttagacaacaatggcttgcaaggcttagacctgaggcaacaatagccccccaggcttccctgtagtccccataaggttgactagccatgacgtaggtgaaacaaggtctgtgatgctttccatatctattctctacatggcaaaaaattgtggaaatgctgcatttctttctaatggttatttcttttataaacagaaaaggttttctaagatttcttttcctgaatcttacaactcattattaaagtctagaggttggtagagaaagcaagaaaaagagaagctcaaatcagctaaatagtttgctcccagacttactataagaggataaaaaatatggctaagtttccaaactcttgaaaagcttataaatgctgcagtaattaactacaacttaaagcacataatgccattataattaaatgaggggaaaagtgtaggttagaataatagtttaaaagaaatgacttgcaaaatctttatttgccacaccattttgaaaagaaagacataggtctaggagatacttgaggtaaactaaactaacacttattagcattgtacttttctttttaaaagttttaattgacaaataataattgtccatattcatggggtacaaagtgatgtctcgatacatgtaatatatagtatgcacttttctacttaaaacctcaactgtgatttctttttaggcatattcttttaggtcaaaaccctcattgtcctttaaatggcatcttacctcctaacttcactttttctacagaaggaaagaatttttaaatttatcataaggtccacccatccatatcaacatcactaccattgtttaccggttcggtggcatagtctcaaaattgtggcaccatataaagtcataagtcagattcatggtgatttgtgattatgcacttattcttggcttgttattgtttctgttttacaaaccatgcaacctaagctgctgcatgtgtgtcagaatgcattgtgtatgacattttacaagcagatggagcacactcactcttcccaacaaccccatcactgaatgcatatatcatattctcttcccctattacagccttcctatctcaaagccttccacctaccatccatggactcctataacatggctgacttcactttttctacttatttttcccaatttcataccatagtgttcctaaccttttctagtctacagtagaaagactctatttaggattttatgggttttttttttttttttttttttgagacggagtctcactgtgtcgcccagtctggagtgcagtggcgcgatctcagccaactgcaacctctgtctcccgggttcaagcaattctcctgcctcagcctcccgagtggctaggactgcaggcacctgccaccacgcccggctaatttttgtatttttagtagaggcggggtttcaccatattggccaggctggtctcaaactcctgaccttgtgatccatctgcctcagcctcccaaagtgctgggattacaggtgtgagccactgcgcccagcaaatttttattgttatcatttacaccaagaggtagaaaaactagatatagaggtaatgaggtatgaatatagagagacacttgtctaaaaacaaatctggctgtattgctttctagctgcccttagacaaggggcaagggtggggagaaataataattattgggtacctattttgtataatgggccttacgtatattatcttatttaatataataaccctacaagataacttcttttatccctactctgttagggtcttcttttctgtattttaaagattaacaagagaaatactgaatatctaaagctcaaataatttaagtaacttgcctaaagtcacagagctaggatttaaactcaggtttaaacccaaagttcaataaatattagctatcctcccccaggaaaagtacagagaatggcaatttgtgttaatcaaagggatcaaaaatagattttttgggcaaagtttaagaacttaagttttcttttagcttaaaaggaagttctaattgccattttaaaaatgagattctctaagtatattgaacagatattatctatttccacaaaaaaaacacttagaaattaaaagtagtttatattttgtgggatataaaggattttctgtgtctgtcttattcacaggacctattatttggaagataatttttttttttgagacggagtctcactatgtgaccctggctggagtgcagtggtgtaatctcagcccactgcaacctccacctcccaggttcaagcgtttctcctgcctcagccttgcaagtagctaggattacaggcacctggcactatgcccagctaattttttgcatttttagtagagacggggtttcaccatgttggccaggctcgtcttgaacacccgacctcgtgattcacccacctcagcctcccaaagtgctgggattacaggtgtgagccaccatgactgacccatttgtaagataattttctaggtgccaggaatttcaaagaataaactaaaatttcatgttccaatgagaataggccacaatacagaaggtactcaaatacagaagataaatactggcttggctatatgttagctaataagatatagcgatgacctacaaggaagatgatcacatctctggacttcttcaaatagaatgaggaaaatcgtttttaagagaagctagaagacatagaaaaccttcaaaactaaagagcttaggctaatgatatggtttggctctgtgtcctcaccaaaatcacatcttgaattgaaatccctatgtgtcgggggagggtcccggtgggaggtgactggatcatgggggcggtttcccaaatgatgttctcatgatattgagtgagttctcatgagatccgatggttttaaagtgtggcacttcccctctgccttctcctgatgccatgtaagacatgccttgcttcccctttgctgtccaccatgattgtaagtttcctgaggcctccccagccatgctgaactgtgagtcaaattaaatcccttttctttataaattacccagtctcaggcagttctttatagcagtgtgaaaacaaactaatacagaaaattggtaccaagagaagtggggcactgttgtaaggatacctgaaaacgtggaagcaactttggaactgggtaaaggtcacaggttggaacattttggagggctcagaacaacacagaaaaatgtgggaaagtttgcaacttcctagagacttgttgaatggttttcatcaaaatgctgatagtaaaatgtacaacaatgttcaggctgaggtggtctcggatggagacaagggaagaacttactgggaactggagcaaaggtcactcttgctgtgctttagcaaagagactggctgcattttgcccctgccctggagatctgtggaactttgaacttgagattatttatggtatctggaaagagatttctaagtagcaaagcattcaagatgtgacctggctttttctgaagtgtatagtcatatgagttcacaaagacatggtctgaaattggaacttaatgtttaaaaaggaagcagggcataaaagtttggaaaatttgtagcctgaccatgtggtagaaaacaaaaacccattttctgggggagaaattcaagtccaagccagctgcagaaatttgcataagtaatgaagagccaaatgttaagacaatggggaaaatgtctccagagcattacagagatcttcatggcagctcctcccatcacaggcccagaggcttaagagggaaaaatggtttcatgggccaggcccagggcccagctctgtgcagccttggaacagagcaccctgcaacccagctgctccagctatagccgtggctaaaaggggccaatgtacagctcaggtcattgctttggagggcacaagccccaagccttggcaccttctatgtggtgttgggcctgtaggtgcacagaagacaagagttgagctttgagagcctctgcctagatttcagagtatatatggaaatgcctgaatgtccagggaaaagcctgctgcaggggtggagaactcatggagaacctctcctacggcaatgcagagtagaaatgtgcggttggagcccccatacaaagtcccccactggagcattgcctagtggagctgtgagaagtgggccaccatcctccagacccagaatggtagatccactgaaagtctgtactgtgcacgtgcaaaagcgacaggcactcaacgccagcccaaaaaagcagccgcaggggttggaccctgcagagccacagggacagagctgcccaaggccttgggagcccagctcttacatcagcttgtcctggatgtgagacatggtgtcaaaggagattattttggaccattaagatttaatgagtgccctgttgggttttggatgtgcatgggacctgcagcccctttgttctggtcaatttctcccttttgcaatgggagcatttatccaatgcccgtacccccaatgtatctcagaagtacttaatttgcttttgattttacaggctcataggcagaagggccttgtctcagatgagactttggacttggactttgagttaatgctggaataagttaagactttgagaaactgttgagaagtcatgattggttttgaaatgtgagaaggacatgagacttggaaggggccaggggtggaatgatatggtttggctctgtgtccccacccaaatatcatctggaattgtaacctccatgttgtcagagaagggacctggtgggaggtgactggatcatgggggcagtttccttcatgatgttctcatgatagtgatttctcacgagatcttatgatttaaaagtgtggcacattccctcttgctctcactctcaccaccatgtaagacatgccttgcttcccctccaccttctaccatgattgtaacttttttgaggcctcctcagctatgtggaactgtgagtcaattaaatctcttctttataaattatccagtctcaagtagttctttatagcagtatgaaaatagactaaaactactagtgattcctaaccttttgagaatgatatcaccccagccatgtttcattttgcaatgttccttcttcaagaagctaaatatccatagccattcattcaacccatcttcaccccatgaccactctatttaaaataccactgcattatggaaatgtcccttcactattttctccacctaagacaggctttttcattcaccctttgtttggtcatgcaacatttatacaggcaactgtatttgggattatttaaaaataaaccttaagtcatgaaatcatagaggtgggcaaattaataaaatataagccctccaaattcataaaatacaaatttcttcattcaatcaggtaaacttgcaaactagtgatttctgatcattttgtagtaactcaggctgttttaattctttcaggagatctcatgtaattaagattttaatttatatatctatatgaatataaacatacccatgcatatatccaggatttgttttgtattttttgtttgtttgtttgtttttgagatggagtttcactcttgttgcccaggctggagtgcagtggcacaatctcagctcaccacgacctctgcctcccgggttcaagcaattctcctgtctcagcctccaaagtagctgggattgcagagacccaccaccatgcccagctaattttttgtatttttagtacagacggggtttcaccatgttggtcaggctggtattgaactcccaacctcaggtgatctgcctgcctcggcctccaaaagtgctgggattacaggtgtggaccaccatgcccggcatacccaggattatttatatcagaagtgatctatatgatttctactagagatttttaccctttaggaaatgtaacaatttatacttatttgtttagtaatatgtctctcttaaaagcatgctacaaatcaattagctttgaacctcgaccagaggaaaacacagggtccctttcatttctgtgatttatttgaacctatccatcttcaaagatgggcagacctaacactaccatttttcatttccattatcctcaaattcatgtatattctggtttgataaaatttttatagtataagataatgaaacaaagacaacataatgcatgcacttaatgaatcttctaccctactagttataaaaataggaagactaacagctaactcttagtgagtgctatgtgccaggataagctctctgaacgtattttctaatttaatcctcacaacacatgtatatgaggcaaataaattatcttttaaaaatagaactaggactagcttttgtttatgccatatttttgagatcctcacctgtatcacacgcacaacattgaaaaaagaactgagaggaagctggatctccctgagcctcagctttcctatcaggttatacaactgtgccattctttacttctggaattttcctatggttacaaaaaaatgttgaaaattttctacatctataacattttggatgtgcaatttccatcttattgtgttccctcacatatggtgttcttgctcaaagagcatcggtatttttaacttgcataatattagtacctactttgaattattcttcattgacaagaatccaaatatctatcacaaattagaaaattacatgtattatttaagctagtgtgttcattgatttttcagacaaatttttcagtagaatcactgtattttacatttggaagagatcatgaagacaatatgaagttatctttttacaagtcaaaatctatagcgcacagaggtttaagtgtctctcctaggtcaatgcttagttagtagtaaaaaccactaatggcagcccagtgttttttctgtataaaaaacatcaaaagttattataaaattcatacttttatgcggcaccctgcagagaatgcaccaggaataaataattggcacattattatactatcagtactgcaatgtgatactttgtctatcagttatataatgcgttcatgtatcattgatgttttggtcacagttttttgttttactgtatgtcttatgtctctaactagattgtgacttccctgtgattggcacaaattctttccttttttttttttttttttttttgagactgagtcttgctctgtcacccaggctggagtgcaatggtgcaatcttggctcactgcaacctctgcctcctgggttcaagtgattctcctgcctcagcctcccgagtagctaggactacaggtgcgtgccaccacgcccggctaatttttgtatttttagtagagacggggtttcactgtgttagccaggatggtctcgatctcctgacctcacgatctgcccgccttggcctcccaaagtgctgggattacaggcgtgagccactgcacctagcccacaatttcttttttaaatgtttctcatagcttttaataagtcctagacatatgcaagctacttaacagagattgacataaatatatttaaaactaataccataccgctcaaaagagaggcaaatgactctaatcctgtacggatgcaggtgaacttgtcagtctgaaaggatcaagttgagaaaatgccctcatttctttaagccctgagattgttcctgagggtaagtggttttaggacttgaagagactggtgaaggttgaagcagaaattagggggaatgatgagggagttgactaaccctcaaggacatgtggcagcataagcagatcaagttgatcaataaaaataatggcaaagcacttactaagcatcgggccctgctctcagtactctgcctgtattaaatcatctacacctcacaacaaccctaggtattttccccattttgtggatgaaaaaaattgaggctcagagaggttagatcatttgcccaagtgaactagctagttaagtggtaaagccaggtttcaaacactgactgctcccagaccctaagctcctaatcacagtgtgatggttaggataagaccagataagcaggtggtgtttaatacaatgcctaacaaatgcctggtcccctagtggaagctcaattgctattagttccccctgctttctggttttcaacccacttgccccatatttatttactcatccactccttactcaccaaacacacacacacacaatgacacattcacacacactccagtctttaacaacgaagtccacactcaggtatttaggtcactaggtgtcaaatctacacatatattcttcttcctgataggatttcaggtcacatacataaaatgagtcctaggaccaacctctgctctcccatcactctccaaggtgaatgtaaacacacacacgaacactgactctggattccaaacatatacgtatgcatagcctgatataaggcagaattcaactctggacttttctttttccgttatccagggaaatgcgtgagttactatgacagatgccaaagacttttggctctggtagtggaaattgggaggcaatggtgaaatgaagtaagaaattccagggccagaaggtggatgcaagtcagcaacggcttttcccaggagcttgctctttttgggtaagtgctacacatacaagccccaacccgctgcctaagctaccctattctgaaccccgctcaggctgcaacagatgacacacagcagggagcctcatttgcaggagatgagtgttcccttgctctattttaattctggcagcccagccggggaaggttttgtcagaaatggtggaaaacagtgacaaccaagctttctggagtaaaggctaggcagctcaggagcaacgaatcacgactcgcacagtattgttaacaatacaagggaaaacaagtatccttcccgccggcccgcacttttgcagccagcttgggcgacccgtggcagcgctttgacgacgacctgccgggctccggagggcgggcacggcggagacggcagcagcgctgccccgcagctccggaaacagcccttcccctatcctcaaggaccaaatcagtcctgataaacacccctcctggccctacaatgggaagggcaagttcaaacgcagggcgtcgagcccacacgcctagagacgcggccaggcacccccgccctcctcgccgcgcagtcgcgcacagtgagcaacagtccagcaccaacccggcttaactgcgcctgcgcactccaggagtttccccccacgcccctttccgaggactagcgcccgtcgcttagcaacgcgcgagtcacagtcgccgcgctttgcgcacccttttcctggcagggctgcgtccctgttcttcccaggaggctcctcgctgcctggtgccgtagaggcccatggaggaaaaggaagataagcatcagtaagtgctggggtttggtgtcttatttccctttccaaaaactattttcctccttcagggggaggccgggatccagcatggacagtccaggccaagctcagacagcccccttgcttctctaatttccagttggctgagcgcttacaacaataatttttaaaacgcaccgtttactgagcacatactgtgtgtcagggacttgacttgcattaccggatctaaaattcttgaagtcatccactccttctcacaattattagcagattctgtagtctttacctttaaaattatccagaatctaccactgctcatcactttcagtactgtgcccacccagtcccaagtaccagcttctcttgccgggatgctgcaacagccctccagttggtggctttgcttttcccttacccctctgcagcctcctcgacacagcagtcagagctatccgtttacagcccaggttagatcgccgttctccatccgacatcgtagagtaaaagccaaggcacctccaatggcctatggagtctacacaacacgccccttaccgtttcttgcctccctctgacaggactctgctacagcaaacaggcctttctgctatcatctgcagtgataaagaccagcatcagcagcacctggttgttaggaatgcaaattttggggacttcccacccccgagacacacagaatcagaaactctatggctggggctcaataatctggcttcaaccaaggcatccaggtgattctgatgtaccttaaattgagactattaatcaaggtagtacatacagctagttaggaatgatgtggagccagggataccctcttccaaagcctgtatttttgtccctggaacaatggttctcacatttgaacgtgcataagaatcagcgaaacagctggttaaaacacgttcctgggaaccagccccagagattctgagtttgcagtgctttctaaaaacaagtaaacaaaaaactaggtacataaaggaaatgggccccataaatttgtatttctaacaaggtcacaattgatgccaatgctgctactccagtgcccatacttttagaagcagtgcgctaaggatggttacacttctgctgggaagctttggcagttacagttcactctgctagaatgcttttcccacaaatatgcacttagctctctcttcccctcttttttcatttgccaccttcacaatgcagcctccaccctacctgaaaatgcaaacctacctcctgcatacatacactcccttttcccattctctattttattattgtccttagcacttaacagactatataatttactttttcatccgcctttccccattagagtgtaagctctatgagggcaggaatttttgttttgtcactgctttatcatcagtgcctccaacagcacctggcacgcaactcaataaatatctgttgaaacaatgaattattcaatgttattctcatatctcttacaataggtattgttcctatcatgcaaatgagacaaaggctcagatatggcagaactgggattccagtccctgtctgactcacttcagagcccatcagtgtttttatctgtgcttttcttctggcaagagattgctcgagtcatatatttcacacttatttatcaacccataggcattcataccacaagtgcttaatcaaatgaatttaactatataacaaatagccccagtccttttcttcaaggacttgatcactacaagtgtatattgttgggtgataactatgagaaacaggtggaaaaaactgatgccagaagcctacaataataaattaattgaccccaaagactctacctttaaataaataattgtatctctggaaaggtaatagaaaaaggtttagaagttttttacactttaccagtaatcagtttttccaaatcctttgcagaaagtaatttttgggaagcagggaactagaatccaaggattctgaatgttgtttttatgtgtactggaggggtggttgagggtattcaaacaaagctggagtaaactccagcagattcaccagaaatatgtaaatgttataatggcagtccatttaccttggatgaacaggacacttttcctgatgttgggcacatggtgaattcaacaatgtacaccttcatggaacttattgactagtaaaggatatttgtagtgcttactaaaaacaagtaaacaaaaaactaggtacataaaaaattgtggtgttaataaaagaaatgaacaaagtactaaaatagagaatacatgtggtagaggaaagaaatctaggaaaagctgctgaggagatggttttaagctgagacctaaatatcctgagccagctgtgctgggagctggggaagagctgtccaggcagagcgaacagcatgtgcaggtgccgtgagggaaaagagattgatgtgtccctggaactgacagaaggcagtctggttggagggtcttgagtgaagtcgaagaggttcactggggcaagtcacacaggacctcagagctacaattaggaggcagtattttattgtaaatgaatggaaaactacttgagggttttaactgcaaaatgatgtgggcgaggcacagtggttcacgcctgtaatcccaccactttgggaggccgaggctggcagatcacctgaggtcaggagttaaagaccaccctggccaacatgacgaaaccctgtctctactaaaaaaaaatacaaaaattagccgggcgtggtggtgcgcgcctgtaaccccagctactcaggaggctgaggcaggagaatcacttgaacctgggaggcagaggttgcagtgagcggagatagcaccactgcactcctgcctgggacagagtaagactccgtctcaaaaaggaaaaaaagaaaaatgatgtggtagaagagatggacctggcattcgtttggaggaaggcaggtgttatactttaagggctgtgtataagattaaacggtgctacctgctttctctgtgaatttggagtttcattgactcacctgctgtgggatcatggctttgattttaaaagcttctatgtaaaaagtattcaaattcatatatttcattctttatttttcaagtatgtgaattttaaaaatactgccttttataatttcaatttctccttatttgaaaggagaaaaatctgataagctgtttcttcctatacatttttaaaatattttattttagtaattttcgtatttgtaacagagtgcttactagaggcaaaaaatgaagagatttattttgactgccacatagtgttcttttcttgaaaagataaataatggtgctcctttggtagctttaagtttgccagacaaacttttaaaattaattggtttatccttgtccagatagctgtttactaggtaaacgggagaataaagccattctcttggtaataaaacttttaaagaagttgagttaactatagcgtgtaacttatccacacacgtgagtactgcaaacatgatatggaagcataatccaatcactactctttctttactccaagcaaataagagttggtgcactgcactggtatattataatgagtaatcattattaacacaaagccctttatcgcttatatgatttagaattagaaaatggcctcctaaattttaacagcacaaacccttataactattaatacagcctaaattgtcttgactgctgtttgtagtatatttaaatcttattttacataattttgactcaatattttaatggttactggggtaaatggtttactatttatgtttttcagacagcataaaatagaggatgctgctataacatatgtaagtgaaaatgaagaaattaaaaacgaagaaaaacctggaaaaagcatacatcattcaaaatcacatgttggaagaggacgtatatattatgctaaattcattaacacaaatgcaagaacatacaatgaaccatttccctacatagatcccaaaaaagggccagaaatacaggttggacagatgttcattgtatacaaatagagatttagattcagatgctgttttgcagaataatttggtcacagactataaaggatgagacacatctcagagtagtacttatcataatccaatagttaaaagcagtaacctgaaactattttgccagctgacttttacatataaacaatacggatacagggagggaatctaagtaattgtttccctagattgggtcagattattgccacaaagtagtgctttggggttactaaagaaatttcatgtatttacgatatatattctaatataaaaatgtcccatgatactcagtaattcacataccttctgtaaaataataatcatttattgaaagcatatgaagttctaggaatgagctaagtgttttatataaattatattctttaatctctacaacaatttctatgaagtcttattggaaatagtttacaaataacacatattcctttgaggttaattaacatatctgagattaagtaataagcaaatgtcacagtcatatttctgtcccagggctgttggtttagccaaaccacacttcactgactatcccatgctaaaaatattccattatcttttttacaaagtcaggtttgttgcggtacaatttattgtattagtttcctattgctgatgttacaaattttcacaaacttgaaagctggtttaaagcagcacatatttattatctagcttagaagtccaaaatccgtctcactgactgttgccaggcctagttctttctgtgggctctaagggtggatgggtttccttgcctttcccagcttctagagactgcccatgttccttggtttatggcgcctttttctttgaagccagcaacacagcatcttcaaatctttctctgacccactctcctgactctctcttataaggacccttgtgattagattgcacccacccagataattcaggataatctccccatctcacaatccttaatcacatctgcaaagtccctttgctatgcaaggtaacattcacagatttggggcttaaatcacgaacatctttagggacagagagagggagcattattctacctacccttacacagtaaattagttacccttatatagtgtataattctctgaattttggcaaaggtgtagtcatgttactccatcacaatcaagctatgaatcatttctatcaccctcaaaagttcccctatgcccttttgtggtcattcccttcctctactccaacagctactgatctgttttccatagttttgccctttccagaaagtcatgttaatggaattacccagtatgtagcttattgaaccagtctttcagaataaagcatctgggatttgtccatgttgctgcagtatgtcactagttcattccactgtgttgctgctacacacttgccatgtgactttgggcaagtcacgctaagcttcaatttccttatttatgtaaggatagtaattgtccctctcatagggtttttatgagaattaaaatatttttgtcagttactgttctagacactagagatacagcagtgaataaagtaaatgggggaaaaaaatcctgtccttacatagcttacattttagtaagggaatagatcaaacaagtaagctgtattggaatgttacatggtagtaagggcagcatgcaaggcagggtaaggaatgctgcaggcagagctgcaattttaaattggtggtcagagaaggcttcactgagtgacatttgagtgaagaccagagggagagtgagggagtgagcatgtaggaacctggcagaagagcattcataatgcacaaaggaagcactcactaaacattagctcttagtagcagcagaatcctagtctactgctctctgcacagtgatggggacttatttgcagctgagagcaggattctatgagagaagacctagtacagtgctgagccaggcaagtgttcaacagatgggattcaaaatatgtcacagcaaaggtaataatttctcatgtaggttttttccagcatatttggaaaaggaaatgtgtaccatctaaatggtctcagaccactgtgccagtgtcagcctcctcctactccacttctttcctcatctctctgtgtgttaggtatagtgatttaacatttagatggagattgctttttgtgagctctcttcgtactgatgacatctgttcttgtcatggacagcacaccatggctgtgaatgtcagatcttcttggggcaggaattcctgtggttaaatgttctttaatttcatgagctaaacccctttaagggccatattgagggtacttcattttgtacacttgcttatgctctcgtaccaattatttcagaaagaaatcaattgttattgttagaccagacctacactggggaaattaatttggtaccaaaatccagattagtgaagttcttacatttcttacaaaggctcatgaatgactctgagctctagttcagggttgaatttaaaactgttcactgaactcatccttacattggcaatactaagaaaaagaagctggtttgagaatagaaatatgaaacataaaagtttaaaaacttaatcccaactaattttctcttactcctactctataggtatgttggaaaaaaaatgaacaaaggtgttaagagctgctatcatcaagactaggtgacagaatagtagtagaatcattattagcactggacctttaagagatggtgaaagtgagtttgagatgaaataagagctcagataagggaatctgtcagtgaatatgaatgaggagagttacagagaaagactgaagatacatcactgagttacaagcatgtctgatttgggtgtggcaggaagggagtgtgtatattttaaaaacatagcctgggcaacatggtgagaccccatttatacaaaaaaataaaaataaaaaaatagctgggtgtaatggtgtacgcctgtggtcccagctacttgagaggctgaggcaggaagattgcttgcacctgggaggtcaaggctgcagtgagctatgttcatgccattgcactccagcctgagtgacagagtgagaccctgctcaaaaggaaataaaattggctgggcacagtggctcacacctgtaatcccaacactttggaaggccaaggcaggagggtaacttgagcccaggagtttgaaaccttcctgggcaacatagtgagaccgagcgctacaaaaataaataaataaatagccaggtgtggtggcaagcctccgtagtcccagctacttaggaggctgaggcaggaggatggcttgagtaaaacagtaaattttttgttagtctttcccttcagtatgatacaaagataaagacgaggctccatccatgtctttccttaatctcataatcttttatgaataaatgcttggaccaaaaaggcacgcacatgttgcatgggcacataagcactttcactcttccaggaacaaaccaaactttttaggcataaggaagactatccagaaacaagaaagacaacctttttttttggactgtaagatttcactcagctaaagtgaagatgcatccaatttataacactcatcagaacactttcacaaactgcagagccttaaagtcaccagtcacattttaggaaaaactgttctctatttcctttatgtttgtgaaacaaagactattttggcaaaattctcagtttaaaagaaatttgctcaaaagatgaaattatctctctgctctaaggctagctttgcattatgcttttaagaaaaaaatatagccaggcatggtggctcatgcctatagtccctgctactcaggaggctaaggtgggaggatcacctgagtccaggagtttgaggctgcagtgagttgtaatcgtaccactatgctccagcttgggtgatggagtgagaccctggctcaaaaaaataataataacaaataataataattaaagtccatcagccatttcctagtggttcacttatcccagagccatttttccagtaacttgagtattagcaaaataagtttttgatcaacaaaagtagatgatatgaagtgtttgtgtatgctttacaatcttatcacagaagaactttctcaggatatttactgctatggtttgaatgtttgtcccctccaaactcatgttgaaatgtaatttccattgtaactgtattaaaaggtgggacccttaaggggtgactaggtcatgaaagctccaccctcatgaatgaaatgaatgccattataaaagggcaagttttgtcccctgttgccctctttttgctcttctgccttccaccatgtgaggatgcagtgttcaaggtgccatcttagaatcataattaccaaacctgccagtgccttgatcttggacttcccagcctacagaattgtgagccagtaaatttctgatccttataaattacccagtctaaggtattctgttgtagcagcacaaaacagactaagacgtgcacttacagcctctattttcacttcttaaataatttcatttggtttgtacttagctggttttgcattccacagcaggtttgatacagcagtgcagcacagaaattagaggtgtgcacaaagaggttggggtttgaattgtggcagtgcagcagtctgctggtgatatatcttggggaagttacttcatctcctggcagttttctcatctgtaaagtggatgtgcctgcctcatagaattgtgatgagcttatataagtaagacaagacctataaatcctagaccttggggtgtaataagcactattataattgtgaagtggagtggagaagagctgccagaagcaggcgctctgacaacagtaagatgtgactattttcagccagatagtgagaagacaccatctgtttagtaatctgttctagaattttcctaggatctacatcaagtagtcttaattttttaaattcaccttttagcccattctgaaaagtgaagcattagccaatctattctccaaaatcccctagttcctaaatttctgtaatctctgcagaaattaccccagttacaattaccaattattccattactcctgcttacaatttgtcattggcctaaaaactggcactcttataaagtgacaaagtgaagtccaactctctcatcagctcttcagggcttagttctttggtatgtgttcatcccatctttttcaagttaactgtaattttccttaacaacctcaagttgaatgaatagttctgactttcctgaaccagattcttctctccaaactgttagccggaacacaaaagataaccttttttggggctgtaggatttcactcagctatgaacaattttttctagaaaacattatttttgctgcctttgacaattgtataaattatcaatttgtaaaattttataaatttataaatgtcttctaagtttcttgacaatcttctgacaagctgactccattaattattttttaaatctaatgttgtatatgtcttttatacatgcctgtctttttagaaactaagctcatttgagagctgactccctatgcagccacataggttttttttttttttaaagaaacatctccctttttgcatcaatgtagccttaattgtattgtcagtattttacctattagaattgcatatttatcccccttgaatcatagtttagaagtctttggctatggaaccatagttgattttcaaaaggcagacttgcttccttatagcccacggtaggtgtttgattataccggaagttactttcatatcctaactgtattccaggaactcctaggtgtcatagggtttctcaagcattttcttactaccacctaatcaaccagttttaaaatatttggtcagaattaagttgagtaacagttcccctctctactctctcaacttccaagaaatcaaattgtcatacatgctaatgaagaatctcagttttccctttcttgtgtacttaggttttagtaccaaaattcagtaacattagagagatttccccttagaacaaagtttatcaaactgagtcattagtgaatgacaaatcaatgagttgcagtcagcaacgtgaaatgaaataggaaagcaataaaatagaatagaaaaatagttaagcacactgcatatagtaagtattttgtgaaacttttgtttcagttttatgtatgtatagcattgtgtgctcttgtatgacataaaatgtatttcatggttcaggctagggactaaaacttctgaaaaccactatttttagatgataatacattatttgtattgtcataatgaaaagattacaacataattttttaaattaaatattttatacatacacgtgtacatatataataaaatcgtagtataaaacaaatacagctattttgctgatttttaccacttcatttgttgatagaaggaaggtagcttaagaattcagcagctgtattttagctaaaaatttgacaactcattttccagtgccttcaaagaaatacattttttgtgaaaagatatttccagatttcagaactccacattagtactgggatatccactaacttgttaaattgaattactgaatatccatagacatcaagcaatacatgaaaatgccctacagtatccaatattgtgtttccaattattttctataaagggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaataggtaaggttttgcagtggtaaaaaccttttatgttatctcaaattattgctaccaaaactaagatgtattagatgtccggacagctcctgaaaataattacttctctatgaagttgaaaatacacacacagcaaatatagcccttgggaagtttgttatttcttcctagtggacagtttgtctccaaatgcagttaatatgacataatgaaaattgtattgatcattaataacaccagcctcaaagtcagaaacttagtagcatcctgctcattgttgttgccaccacattttaagagttgtaactattgtcacttcaaggaaggtagctgatgaagagggctattagataatctgtaacaatgacttgtcctttagaaagataataaagtttccacttctggttcaggatagcagactgagcacacatatctaaattccctgccttccaagaccctattactataaatagtagcaaagcaataaactcttaagagtgaagagaatagaaggaagaactttctggaacgtagcaaagactagaagcctattgatagataaaagagaataaagaagcaatttctagaaggagatgcaggaaagaagagacaatctgcctggccaaagtcctgactgagctacacgccgagccagcaggcatagtggaaggcaaaaatgaaaagcgggtaggagagagtcagagagttacttcaaagcctgtcccttaaataaaggctccagtcatgagcactccaccctatcccaacattaagactactagagcccagtgtcttagccagatgtcaactaccacaccagttatttcggtaaatcaagctgatcccccgtccgtccccttcttataaatggacaaccaaagattagaattatgccagttaaaaaacagatttggagaataaagtcacggaagtatcacacagcataaaacaacaaaacaaaagcttggaaaatgagaaggaaagcaaaacagaagatctgtttgggaaatccaacttttctggagctccagaaaagagaagagtaaaaatgaaggtagataattagcaaaacataacatttattgagcacatactatttgccaggcactttatggaactttctaaatattaactcatttaattcccacgtgaactctatgcaatataatagtgtagtaatactattaatattcttatttttcagataagaaaatgtagggaggcaaaattattttttaacattttagtgtttttggctgggcttgagaattaaattgacacaaagatcaacaggagaaaagcatacaaatttatttaatacaagttttacatagcaggggagccttcataaggaaatgaagaccctaagacacagaaagaacacatatactaaattggacaaagagtagtacattgtaaaaatgggacaaggcaaaggagtttgggctagggtaattgggtagagaaatgactaggaagataagggtgagtttaacaaggtttacttgtctagatttcccctcacctcaaattcctgtgcttggtaagaatgatgctttccttctggtatagggaggatatcttttacataggaatttcatctcctgcttttgagaaagagaaggaaggtcaaactgtttttcttgcatctgctgtttttcaagtgcctttaactcaatatagtcaatatgccagagtggcattttagagtagcatgttctgaactcctttgaaagcaagcatggagttgaaataacgtgcccaaggctagagtgaataattggcatttgcacccagctagcctgactccagtgcatatactcataaccagtactgtatagtactctacacaacctctaaaataataacaaagtttccctacataaaatgcattaaaagggtctactgggtgcttctaagtgtgaaggggaaaaatatgcacaccctacatatcattacaaaattgcaaaacagtcatcatcaacagaagattctaaaagtttccataaagggatagaaaaataagtcaccatctaagaaataagtatcaacatggaatcaggcagcactgatgcaagagtacaatggagttaatatcttcaaagttctcaggggaaatactttttgacctagaaaagggaatttatttggcacggatactaaaccatttttttccaagtggcactgggcattacacccactgaggaggaaatgaagtcctggcacaacatttgacccttaaatgaacaaaatgtatgtaattatgtaatactatgcatgctgtttagtagttttcaacttttaggctcaatctatagacacgagtttaaatatggttacacaacagaatgtatcttagcagctttaataagaaaagtaagtgcacaactgatagaagatgagaagtagaagagaagaagggtgctaacatcattatttgcaatataggtaatcagttgatactatccagtgggggtgaaacaagaaatagatgtttaaggtgaaaggtcaaaggaaccagtctaaaaaccaaatttctctaaccctggcttatttactgagcttcaagttcacatatccaaacacctacttaacatctcctcttggatagctagtcaccttttcaaacctgatatggctggaatagaatgtttcatttcctccatccaaacttatcctccactagtcttctccatctcagtgaatgccacctccactctcccaccaggtgttcaagttttgataagctagaaggcattataaaactctctcctttcactccctgcccccacattcaatccatcagcaaattgtgacacctctatctccaaaatagaccccaaatctattcctttccatcttcactgtaaccagtgcagtacagctgctattaccctgcttcctttcttctttctccatatatgttttctgcatcattgtcaaaggatctttttaaaaacacatgtgatattctcctcctttagattctccagttacttctcaacgttcatagaataaatttcaaattcctcactatggcctacacggccctttttgatctgtcaaatttacctacattatcttctattgctcataatgtgaggatttagagacagagaatataactcagaccaaggaggtagagacactctctgaaagttaagcttgtttccaaaccagatttatgtctatgtacttgttactgtatttccatattttaattatatattcttgtaaattaaaatctgaataagaaaagaaaacagttgtttctataaaacattcaaaattgaatgtacagacttgataaaaggtcaattgctaactttaaaaaatgctaattaggtataggcaaaataactaagaggagttggactgaatttttaaaatcttgaaggattttgcattcattttgcttgaaatttgtctttacattttcattctgtgtgaaagaaatagaaactggaaatgatgcattagaagtgtggtttgtacaagaaacacaaagtggaattccagtcagtggacacctcctcaaagaaaatggcttggcatgccaataaaaatttgatgaactggttaaaatatgtatctacatatggcatatgattttttgctttaactttctttggtagccaaccagtcccttccacataacgagcagttatggtacttcagctactcaagttgaagggatgtagaagagtggtgaaagatgacactggagcgatgggctttttctgggttcataaggcagggctcagtcatttcataagggatcccccaaaatcagggtctgtagatctacttaatttgcccagggagaaatcctccaaacctctgcctaggatggaggacagaaaatccaggagtcccataagcagtcctctgcaacatcaccttgtcccgctgccccatgctccctgcctcagaggtatctgatgcctcccgattcccaggcactcctggaatgctgtggcattaattggcttaatttttaccccattcccttcccccatagcacttaacttccagttttctgcagtttacttgagtctattgctacttatccatctgttttccagcttccaaatttgttaaaatcttcactcttatttagttcttttcttccttaaggacgtaagccctcttaaatttctgtagtgtgattgtactggggcttggggaaagaatgggggaaatgcacattgaatttgccatgtttaactggaaatcacagcaactttgtcaccatcaacacttcttttataatattggttcagtattaaacttagtattatgtgaacctgaacccattaaatttaatcatcctgttttgctcaatttatgaagtgagaataattcctactttgcaggattgttgtgagaaacaacacgtaaagtgcccaacacagtgtttgctacatagtagacaataaatggtaactgtttctattatcagttattgcattgtactaggttatgtgttgagttgaaatttagctcaagaacctggcatgattctctctctgttcttttattggtatttctttttctttctctgttcttttgttggtatttctcatggccaagttcattattgtatcctagggtctagtacaatgcccagattcaataaatatttattagttaaatgataattatacattcttcaacaaagtcataatgtaatttaaagtaacatgtactgcacaatataggcctgcaatttattcatatttcaggtatttggatattagatgaaagtgatttttaaaaaacaaaatattttaatgtaacatttaaaaatatgtatataaactagtctatatgtgccagattttttaccataagcatatgaacatgcacataaacatgcactaatatgtgcatataaatatgcactaataccaattaaaagtcatctcatagtcattctgttccatcagcccacttaattacgcctggactttggcatttcagcaatgttatcttgtgccgacaattcaaagtgctctttatgtcttctaccacacacaatttcctggctgccatccacagtcagttaacaaacagctatgctccatcatatttgagtccctgtaagaataagtgttcacatttggttttatataataaaactttataaattggaaagcctaatctaatatgtgaagggggtatttcgtacttaaataaaaccttgctgattatcaacaacttgatatttcaatgttcttttgaattgcaaattcagatatagtggtaaaattaattttctaaaataggttttagtttgtgttgcttcttttgcaccaaaatgtaacaacaattttttgctacagttatgcttttttctttttactgtattttgaaaatctatactattatttttatattaatagtctttatatataagatcagaatactgagaagagtgggatttaagagaaaaatattactggtgaatgatctttaagcagacacaaagaattaagaaaagaacatttctcaaagtaaaactcctaagttctcaccaatagaagaagcaaattgtatgtttgaataaatcctggctttgctgataaaatataaatggttagatagcaacttgtttagaaaattctaattttaattagatcaagtttccaagaaacagagagtggatttcaaacattcttcatggactttgccttattttttgcagttctcatcaaatgaggcttctttcaagtaattactttgggtacaatttgaattcttaagtagagtaaccactaacaatctgaatatcttctttgatgttttcatgtttagatattcctcactattgtgggcttctgtaaatgtctcatatgcctgtataaatgaacacagtcattatgtttaattttaataggtgtaatgcctgaataaggaatttccctttataataactcagattcctttctcccccctttatttccgtgatgaaaaagaaatctttttttttttttttttgagacggagtctcgctctgtcgcccaggctggagggcaagtggcgtgatctcggctcactgcaacctctgtctcccgggctcaagagattctcctgcctcagcctcctgagtagctgggattacaggcacccaccatcatgcccggctaattttttaaaaatattttttagtagagacagggtttcaccaagttggccaggctactcttgaactcctgacctcaggtgatccacctgccttggcctcccaaagtgctgggattacaggcgtgagccaccatacccagccagagaattatttttaaagttattatttgtgagattatgggaggtttagattactatttaaaagattcattttaattgatttgacttccttctgaaatatttgttttagttatttgcataacaagctacctcaaatttaattgcttaaaacaacaatcatcttattagctcaatgttctgcaatcttggctgagttcagctgggtagttcttggtctggtcagtgatggtcacttgtgtggccacattcacttggcagatggactgaggactggactcagctgggatgcaggaatgactgggcctctccttctccaggtggtcactccacgtggtttctccagcagggtagctggacttcttactcccaagaatgcaaaagcagaagctataaggctttcttaaagtttatggctagtactggcatagtgttacctctgtcatatcctgttggttaaagctaatcacaagaccagcccacatttacggggaggggactatataaggatttgaatactgggaggcctgattcattggggccaccaatttaacagactaccacaatacccttcaacagtcatttaaatgagagtttaggagtagccaactcttcatctttcattgtctgaaaatgtctttaagttgcccacactctttaatgaatgaaagcacagctaaatgcagaattctgggttcacaattaattaccctttacactttgaagatattactccactgtctcctggattttattgttatgtcaagtctgcaggcagttcaaattctttgagggtaatctgtttcagtataagattcttaatttcaaagagagcctttctatataaaaaggtattcatagttacttatgatttaaatattccagtttgaacattataaatttgaaaaatatgtttcaagtctttaatttttaaatactgtataaaataagaacagcatctttcacttgtttgacatttaactcaagttgaacaaatgaaatataccttaacaatgactcttttacgaaacaaagtcaattaaattctgttagcattttaaattgcaagtttgttgatttaattatgttctgttttccagaactaccattcaaccagcaatcacattactgggtatatacccaaaggaatataaataaagacacatgcatgcatatgttcattgcagcactattcacaatagcaaagacatggaatcaacctaaatgcccatcaactgtagactgcttaaagaaaatgtggcacatatacaccgtggaacactatgcagccataaaaaggaatgagatctggtcctttgcaggaacatggatggagctggaggccattatccttagcaaactaacgcaggaacaaaaaaaccaaataccacttgttcttataagtgggagctaaatgatgaaaacacatggacacaagggaacaacagacactagggcctgttggatggtggagggtgggaggagggagataatcaggaaaaataactaatgggtactaggcttaacacctgggtgatagaataatctgtacaacaaacccccatgagacaagcttacctatacataacaaacttgcacatgtacccctgaacttaaaactttaaaaaataatagttactatattctgttttcttctcaaatacttcaaacatctttacaagaaaaacttaaagctttgacaatcaaaacatttccaaatccttaaataatttctataaattcaataaattaaacctaataaatcttataaaacctaataaaccttgtggctactgtgggcttactacctatggagcagccctgttccacaagaagaaaaaaaaacctaagaaaacttgcaaaaccttgtaaatctaataaactcagatatcttaaatattttaatactgtttataaacttaatcagatttccctaaaattgtcagcacaacactagtatttgatcaaaatttttttgacataatgtactaaataacaaattacaggtttaactttctttgctttctcatctctatatttaatcccaaagtttcccagaattaaaaaggtttaccaaccatttactttagtagtgtgtaaatcccagaaaattggttttgagtattagtaaagcattaaatttgttttatattggttttgaaaagaagccactctataaccagtctttacttgttacactataagaaaaattgtctgatatgctatttgtatttaatctgatccatggctaggtattattgtgattattacagacagtgttaactgacaaacaaaaattgtttgtatctatacaaaacatccttacaacatgatgttttgaaatatacattgtgaagtggctaattaagatgtttattacctcacatacattatttttatggtgagaacacttaaaatctattattttagcaattttcaagagtacaatacattaactatggttaccttgttgcacagtcatccctcagtaaccaggggattggtttcaggacccctgtggataccaaaatccacagatgttcaagttccttatataaagtagtgtagtatttgcatataacctacgcacatcttcccatatactttaatctctagattacttagaatacttaatacaatgtaaatgccatgcaaatagttgttatcgtgttttttatttgtattatttttgtggtttatttttcctgaaaagttttaatccatagttggttgaatatgtggatacagaacctatggatagagagcaccaactgtacattagatcttttaaacttactgttcctttctaactgaaatttcgactcctctgaccaacaaaatctccactgtcctgctccttccagagggcttttaatgatgacagattttgctttacgcagttcacttactaaaacatcactataacttaaattcatcttatgtagatctccttgcagtaggtagatgtaaactctgttgtctgaggatttttcaggtgtggaaattgctgtcatctgattttaacccaatagaaagcatagcatatacatttccagtttggggcagcttatttgccccaactgttactgtcaccttaggcagctgtaatgttaaacaaccgtccctgattgtttcggatgaatacttggtcgtggggtgaggcaagggcagggtggcaggggtgcataattcacttttagggctctgagtcatgtctataaagacgaaccctgcaggccaggttaaatagtgacagttctcttgagttggtatttgtgagacactccaaaccccttccgcttcttccagtagttgataggcttctggttttcatcataattgcagggctcttggttttcaaggcttctgcagaggggagattgggagtggggggagggggaaactgcatgagttaaaatgtcatcaaacttgcttttattatgaagattaagccatttttcttgaataaatgctccttagattattgcatgcctttcgttaatctccagagttctaaaaaagttgattttgatgacttttgccagtgtattcattgcttttgtggaggagcagctttttcaaaggtccttaactctgaaattaccactgatgttctgtcccattagttcccacgttacaaatatctccttccaatctgccatctctattagctttgcccatggtgtctttcatcgagcagttctcctatgttttttaatataatcaagtttttaccttatgggttgtgtactggctgttttaagaagggtttttcctacccttaggtaaagaaagttttctcctacattttcttatcttgattttatacttttaccttccataattaggtctttaatcttagagtccaccatgcgcgcactattaagtagggaatcaattccactttccagcatagagtgaaccacttttctgaaaaccatttataaaataatctgcacttttcccatttacttataggacctccttaattttatgttaagattccatatataaatgagtttgtctgcaagctctctgttacgttactcaggttaattttcagttcttggatcagtaccaaaatattttaattatatggatttttagctggtcttaatatctgatatggaaagtctcaattattcacccttccttcagagctgatttatgggatttatttttctatttaaacattgaaatgtatgacattgctcaaaatatccagctagaattttgattaggttgtggtgacattatatattaatttaggaaaaagtcaccattataataaaatgctatcatcctattcaagagcatagaatgtctattcagttctacttttaggtctttaacagaatttaaattttttctctatagagatcttgtgaatgcttttttaatttctagaaacttcatactatatagtttctgtttctactaagaatatatgttatttttcattatatcttctagtaggttatcactattgtagagaaatgctcttgatttttgatttttatacatttatccgatgtctgtttactttgccatactcttattctcataattgatggactcttgtggtttttctattcaggtaattatattacctacaattactttttttttcctcctttgtaatcattgtactacttttttcttttttatagtattcaccaggggctccattaatgttaaacaatagaattttagttctgagtttttataggtataatacttagaattttctgttctttaatccttatctttttcaggaaacaaaaatttttgttattttcttccttatatatcagacatcctctttgatttatttctagtcttgaattcttcctctagtttttcaaagtaggtctgttttggggggaaatcatctgaggccttcctttccttcccatgtttttgaaattttggcttcacagttaaatgaaaatttggttggatataaaaactctaggcttaaagtgcttttccttttaatattaaaaaaattaattatcttgtgtccaatgttgctattgagaaatttgatattaacctgttgttactccttcataatttacctctttgaaagcatttataatttttctttgtcccagatgatgttaaatttctctattaaatgtcttagatgcgagtttttcctttatctgtactgcaagatcgagaggagagtgagaaacccaactagggtgtaaaatttaaggaggcactcactcccagggtcatgcaagtgcctccttaaagttttgcatcctttgtgtctcattgcctcatttttctcctgcccctgctacctgtttggtattctgtgagctctttcaatctgaggtgtttgagctttctttaactcttggatatatatcatcatcattttctcaaatatttccttcccttccctctatttcttcttagttctggtgttgatacttccaccttccatgtctctgagcttttctttatttctttatcctttcctgctgccttctgggacagcttctcagtctgattttctagttcatgattcttgttgtctagaccatgtatttttttgtttcaactgttatattttttatttctaacattttttgttattcctttttatgacctgttcttgttcgtattaacaatactttgttctgtatctttgaggatatttgttatgcttattttaaattcttggtatattggttctgataattctccttcacacagtatatgttttaaaattttcttttatggtcaaatttatggtagatcatattcccctaggggaatcagtaggcctgtgcagacaaaggctgaagaccagggtctggtttgtatgtctcccactaaatttgaggaaagaaaatgaggctcaggccagagagcttctggtatcacaaaacctatttagaccattgttaattactgtcactctactaggctggtcatgtagtcaggaatccaccctaccacccttaaactgttaaaaaaaaaaaaaaaaaaggcatcactgagataagtcagtatcttgatgtttttaattcaccagcattgacggttgctgggggaatgttggaggaagaaatgcccaagggggcaacatgtacccattttcatcagctcgttatcctggagggacttctgcgcgcttctgctattactgtattgacaacaactggctaggcagttgctgccagtttctgtggccctgggcaagcatgatcttcccaaggcaatgtgagggaaattcaagagcagattttaaaagctctcccacaacttattcttcttggctgcatctgaccttcctaccctccagtccaaattgccaccaacccttcgtaccagttcactaaagcctttgggtttctcacagtttttttttggtagctccggttcctgcttccttttcccttccatagtttccccttttgtcaagatacaaaagagctggccctttgctaactttgaagactccataatttgaccctagcatcctagagacttcacaaacactgcccttaattttcacaattcaaaaagcaaattattgttttcttcattttagagaggaggaaatagaatttcaatgaagttcagtgatttatttcaaagtcacacaactaggaaatgtggtaaagccagaatttgaaaacatgtctattttattaccaaatgcatgctttggatacttcattaccaccacctaattaatgcctaaatttagagccgcttcattctgtctatacacgaagttatgaaactgtgtctgcacatactaatgttctgtgagttggaccatgatattcataaaaaaaatggtcatcttttcccacttggtggaaaaaaatataaattatagatagaattttctcagtgtcatgcttattaaatctttgcactactgttttctgttttctagcaagttctaaaagaaaggtaatgattaagtagaaaatgagttttgagcagttgattgcaattagaaatcaagaaaatgttaacagttaactttttttatactgctaactgggaaaagattgccattttgtaacatgtaatgtataagtatttgaatattagtcattcttgctaataaaattagtttataacaatgtctgaatatcaaagtgaattcatgaatgcttaatacatgtaaatttactaacattttttcttatgtattcctctaattttaaaggtgtgatttttaaaagttaaattttattttttaacagttgatataagcatatggcacaaaattcaaatggtacaaaaagatatacagtgaaaactgaatctacttctccccacctctgtcctccagtcacccagttctctttccctacagtcaccactgttaccagtttgttacatagcatttcacagatatgttcgttgtacataaactcttacgtacttttttttttttttttgagacagagtcttgctctgtcacccaggctggagtgcagtggcgcgattttggctcactggaacctctgcctcccaggttcaagtgattctccagcctcaccctcctgagtagctgggactataggcgttcaccaccacgcccagctaatttttttttttttttgtatttttagtagagacggggttttcaccatgttggccaggatggtctcgatctcttgaccttgtgatctgcctgcctctgcctcccaaagtgctgggattacaggcgtgggctactgcgcccagccacatacatattttttaagggagaaatttttgtccttgatagaattttacttcactaaactttttttattgccagcaacagtactgaaagttgctctgatctttaaataaccttctctgctgaaagtaaaactgagttttaaaaattatttaagatgttaaacatacatggagcacagaccaatataatgaactcatatactcatcacccagattgaaagattatttagaagtgatttttaaaggatttcatactcttgcaaatttttcagaacccctgttattgggcgaaatgaaaagaattatgtgttcaactacaactgcagcagccctagagtcttccaattccattagtgctagcttcggcatacaatttctaccctgtggccacagccactggccaaactatagattcaacatagaatttctcatactctttctagtcgtgaaaagttaacaaattatagttatgttttccctaaaatgtattggtatctgtgtaaaaagcatatctaacaatttttttttttttccttaatgagacaagatctctctttcgcccaggctgaagcacagtggtgcagtcatggctcactgcagccttgaacttttgggctcaagcgatcctcccacctcagccttccaaacagctgggattataggcacatgccaccacgcctggcttattttttgtagagatggggtttcaccatgttccccaggctagtcctcaaactcctgggctcaagcaatcctcctgtcttggcctcctcccagggcatgctgggattacaggaatgagccaccatgcctgaccatattgttgtattaatattaattttagttttaaaaattactaataattccacacgtggggctaatttggttgttttgatttggctcttttcatgaagaatggtgaatccattctatttattatttagattgtgtaaataatcttgcatacttcaagaatttagttttgttaccatattttatattattaatactgattatatgtccataaacaaatctaattttttgtcctgacttcacaaaatcttttttttagtaccacttgcctctcctggtacatcagcagaacttcaaaacaattttatagaatacatctcttttatacatcaatatgatgccagaaaaactccgaatgagcctctccagggaaaggtgaggcagtatttagaattatttaatactttaagacagagtagatttgtagaactttaagctttttcaagtcataattatctttctgtctatttaaacaaactacttcagttattaataggatagaatgttagccacataccatagtaaaatgtaaggaataatactatcctggtatggtggtgccacctgtagtcccagctactcaggtgggtgaggtgggagagttgcttgagcccaggagttcgaggctgcagtgagccgtaattgcaccactgcattccagcctgggtgacacaatgaaacctcatctcaatcaatcaatccaaacataataatttgaatcagtctttggaatttggtctacttaaattattgaaataatttgtgtaaaataatatcaaagcatgctgggcacagtgacttgacgcctgtagtcccagctactctggaagctgaggtaggaggatcacttgagtttgaggccagcctgggcaacatagcaagtctcatttctaataacaataataataataataataataataatagtaataatatcaaagcagtttgacaaatgttttgatatgcttaatacatgtgtgtggcagggagatgcatgtaaggtttataaagccaaatagaaatgtaattgtcaattattggatttttttccaactatagatgtttgctttcatattttattattacttagcttttcatcagcgttaataggcatttgggatgcaatcataaattcttaggtctatgaactgtagtttttgttgtatccatagcaatctttagagcaagaaatgaaatttgatgtgaatagtcttaaacagtccaaatgataaaaaagttgagaatgggagatgagctgctacttctttgacattctgcctttttccttcctgttcattttctgatgcaccctattttataatttaaaaggttcacccatatatggtggtgtctagtttgggactgaggtgacaccaatgaagaggcagagaagtgcctgcatcactgactaggacttgagctaacgcacaaattcagttcacagctgcatcttccagcaatctgcgttctcctggttaatgtcgactttgttttcttttccagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcttgagagcagagaaaagacctcaggcgccactcaaacaactgtaggagatgctcttttcactaggcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtggtctccaataagtggagtgagacattatttctatgtcacattctttatgaacacaactttgttttgcacaacacatgatcgtaattaacaaatataatacttttagaagagaggccctgttagacatgagtggacagctttggaatcaaacaaactagagttggaatgttgccttcacttcattccttgagctgtgtgaccttgggtaagtaacttaacctctctagacttcagttttctcaactgtaaaattaggaaaatagcaacttcgtaagattattgaggatgtgattatgcacattgatcagtaagtggtcaatgtaatcatatcatcactgctactataattcaattttcaatttaaggataatgttctcttatatatttaatttttcctcattattctaaaacttagaactcctccatatataattaaaagtgtgaaaatctaaaaatacttctgccagtacaagatgcacagacacatacacacttaattcaaagacatatgggtacttagaatattgaagtattttctaaattgttttctattttactcagatcatttctagcaccaactcaacctttgctttttggatgagtttggtaaggattaattctacttccaatttggtgtgtttggtgtgccaaaatgtatctattataagatatgttatattgcatacaagtggaagtaggtggagtattcctctgttataaagagtatttacaaatttccattgggaaatatcagctgctcactattatctgcagtattgataagactacagctatatctttatccatttattctccattaaagaaattgtgataaactgcaaaataatgaatgtcattatatttttttgtgttggggacttctagttcttgccacatatatatctccaatgtatatcttggagatctttccttgtcaacatatgtaggcaaccttgttattttaatagctccatagtcttcaacaccataggtatactactataaaattggaaaaattagaatgcaagttttggtatgaagacagggaagggagaggttgttagcatgtttggaaaaaggtcttaaagcctagggacttgaatttttatcctcattggaacagggatggaaacttatgtcctccaaagtagaaagatagaattgaaatctgcataaagctagaactctcaaatggctggcctgtcagtacaaggcagactccactccactcatataaccaggaagatagcaagaaaatttgcctctgcctggagctatggatagtgaataaactccttgtgaaaaagtaaaaccccaagcttgtaccatgctccagttaggaatatgaatttacatgtaagacttctcttaggacacaaaaccaaaaaattcctctagtgataccactgaagtccctgacaaaagcaaatgcaaaccctccctggagagagtttcatgatcaacacaaaaaaggaatccctgttaaagatagtcacaaacaaaaattacaaatcacaccaagaagaaaaccaaactgagcaagagtctgcagtacaaaagaatgactataatttcagaactggagataaaagaattaaaacatataatttcaaaactggagataaaagaattaaaacactttcaatttgaagatccttggtttttttccaccttagaaaattttattatgttgccttttctgttatttccatcccttccattctttctcttccctctttctggaacagctattagctaaatgtttgaacacttggatctatcgtctatgtctctcattatctgtctgtgtgtgtatgtgtggttttttgttttgaggcagtctctccagagccaggctggagtgcagtgccttgatctcggctcactgcaatctccacctcccaggttcaagcaatcctccaacctcagccttctgagtgctgggattacaggtgtgcaccaacacacctggctaatttttgtatttttagtataggcagggttttgccatgttggccaggctgttctcaaactcctgagctcaatttatctgcctacctcagcctcccacagtgctgggattacaggcatgagccactgtgcatggctctcattatctttctcatggtacttcgccactaagtaatgcaagaattccgtgacactttctactaatttgcttttcagccttgtctattggtatgccagtccatttattgaaacttaatatttgaccatctattaaacttagtatatatttaatatccaatctatacatgtttcctcagtacataagactcttgctctattatggatatgatcatctctcctaggatattgtagttatgcttaaaatgttttgtttgctctctcaattctattaacttttgtttgttgagtgtgaacctcgcactctgggtattgtactttttcccaaatgcttcacgtctcttaattgtctactcttcttggattatatggtttccaggttattatcagtttctgttgactatagcctgactttgggacaagtttgggatgtagacaggagctgaacatgatttgtctgatgagctctttggtcttcctgggggtcggtagctacttgggcattaccctgcttctccagccccagtgtatgatttgattcatgccacagttaccctggcttaacatagcagggaaacagaaagggaatgactggtttgctgctccacatgcagttccctaacttttcaagttgataaatggcccaaggcttcttctacctcttcatattcattgactctaggcttgtagtcctatcagacctactatcaggtcatctctacacaggttaggcttttgtttcctttagttttgttcttctaaacgtgagttctttagtaatatctttcaaaatttatttaaaaatttttttttctgatcataagtttccctgctttctaactctattaaaatggatttcattatctatatttatctacattttatggactttagagggcaacagggagtggctgtgtgtgatcagtccaccatcttgagtcaatctctaattttctaaatcatttgcaaacttagtactttaaccattaggaaataacacattctctgcaacagacctcatggttgactgacaaatgtcactgaggattgacacagtccttgtgtcccacataatttagaggagaatggtctggggtcataagcccagtgagtggttcctaccacaggctaggttggttctcaatcttttcaaacatgagggcatcttttctgcatgaagataaaaagtttatggttcctcacaatgactgaaagtcattgaactttcagtatccattgtgtgggaaatctgtaataaaatgcaatgatgatttccaggtttaagtctctatttttttaaatgcaaagggtgtgtctctccaaaatgaattccatagtctattaaagtcataactgcctgtcagtacaagtagtgctcttaaatttcacaagaatatttgaatgtttccaagtagttcccttattatttccaaagaatgatagcctttaccaggatacaagatcatttttcaaattacaaaaaataaaaaagaaaaccaaacaaaaacaaaaaccatcatttattattaaagtcaaaaatactttaatgaaggtgctaatggtttctaacattgctattaatagcataaatttgtatatgttaagtactgaagcattttaaaatctattatcttatgtgactcttataataatcctatgaagcagggcaaataataattgcatttcacagctatttacagagaacataaatgatttccccaagtctgcagttagcaagcaactaggaccagatccagagtttctcaataaccggtccattaattcccagatgttaaccaacagggcaatgctggcccataacaaatgaaaaaacaaggatagaataaagaagtatcaggacaaataacttcaattcttttattgaagagactgcaactttactgcattttgggatttaaaatactctttgttagactccttactgccttaacggactacgttgatgttggaagcacccatcatcccgaacacagataaatgtaggataaaatataacaggaacatttgaaatatacaactaagcactaaaacaagaaattaaaatcctcaggtgccagaaatggagagaacacaaacaagcaatgagcaagaggtgagactaaataagcaattgcagagttggaatcagaggatgaacttgtgggctgagattttaatgcctgagctggaatgggaatggaagccccaggtgcagtggagttggagctgtgcaaagagccaggatcctagaagagctttgctgctgtgaaaataattctgggttatctcctcccattagcctgggaattaggggaggtagtagattcattaccacctagatgacacacctaccaaactgagctatgcacaggagtggggtccagtgtgtattcatgagaaggaaatgcaaaccaagaaagcaacagaaatactggtttgaaccaggaaacttgaagaaccctgttaaaaacaaacaagaaattgccccatagtgacaattaataagcctgcacacacgagacaatgtggaaaaaaatcccaagatgagatggttaaaaacaaaaacacaagaggaaagaacaaaaacttcccaggaaaggagttagcagaactcatatgccaagaattacagacaatagaacagatagactatataaagtaagtatacttaaaatgactcaagacataagagaatacaaagtatacagaaacctcttgcttctgctctcaccatgtgatatgctggctctgcctttgcctttgccttctgccataattgtaaacttcctgaggcctcactaaagccaagcagatgccagtgctgtgcttcctgaacagcctgcagaaccatgagccaattaaacctcatttctttataaattaaacaaaaagtatacagaaagaccagaacaccataaaaataggcacatttgggagggaagctatagagattctacagtttaaaatgtctaatttttaaaaaacttaattcagtagattaaacatagcttaagagaaaatcagtaaattggaagataggactgaagaaatctcacaaaatgcaacacaaaaagatttttaaaatattaataggaagacagagaatagaatgttattaagagttccagaaggatattatacaaggaacatgagaaaaaatttgaaacgaaaatggctatgatagagactactacttgtttcccaatagccagtcattacctctgtcttactaataaaatcacccatttttagctggaaatttggctgaccagaataaagacagtatttcccagcttcccttgtagctgggttgactatattactatgttctgggatataaccagagcagcatgtgcaacttctaaaaatgtccttgaagggaggatgtaggcactattttctttctagtagctggaattc

SEQ ID NO: 20 - DNA, 4350 bp, Homo sapiens
agttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattca

SEQ ID NO: 21 - DNA, 191942 bp, Homo sapiens
gaattccctcacgtgtcaatcagttataaggactcaagatgtgccgtgggaagaatgcaatctctctacctccaatcccaccatttgcttgtgagatcaatgttttaactcctttaagcacatgtattttcttattattttaacctagaaatgatatatgcttgcattacttttctcatggttatttacaactaattgtggagtaaatgaatttagccatgtttaaaaaaatttaagatgtcagcaggcaagtgatagaggttgtttaatagaagttctcttagcagcatgttaaaaataatgctgcaataatatcatctacctaaatggttactcctagcagtctgatgccaaaatctaaacaaatctagaatttttatatgtggagtgacagttgtacaaacatcacagtattcacataaatattttgtataagttaaattatctaagtttattattaagttattatccttcccatccaaaatattttttaaatcctaagacaacttcattgtagttttagttattacaaactggagcaatctttagcaagtttgggaatatgaaaataatagcttatttaggctatctaactattgaatttgtttcatatttcagttcacccttgaacaatgtgggggctataggcgctgagcctcataaaaaattagcatgtaactgttgccttccccaaaacttatctattaatagcctactattggccagaagccttactgataacataaacagttgattaatacatattttgtatgtcatatgtattatattttgtatttttataataaagtaagctaagtaaagaaaagattattaagaaaattgtagggaagagaaaatatatttacagtactatactgtatttatggatactgtaagtttatgttgtctgtttaaaaggtgaattgtccatctgaaatggtgggcagctgcagccgcaaacctcaatttatggtacatatcaagcaattcatctttttcttgtaatggcatgacttttctctgcttgttgggagcacttccagcatcactagtggcactttttatggatcccacggtgttattcgaggtttctagtattgcactaaacacaatgaaaaatatgtgagagccatgagagatcagtttttactgtgacacacaatttactggaaagatgaactgctcacacagagatgatgttcgtcacacagtgttttaagcagattcttgcaacacttgagctccccacaatggcaacagaaggtagctatgaaatcattacaatagtacagtatgttctacggtgaattttatgaagttatgatttaatactgcatctttatgtttatttccatttctctcaactgcaaatggcactatgtatagtctgtgtttgtgtaagttttgataaattttaactttttataatagagttacatatattttatgttagtaaacaataaaatagactaatatctacatatattttatgcattcatgacatacctaactttttcttagtattttcaatatttctaggctgcatggttcatctgcatgttttttcaaattgttgcaaatttctaaaaattttaaaatatatatatattttttgaaatccacatgtaagtggactctcaaagttcaaacttgagttgttcaaaggtacttgaattctctccagcctttctctttctgtccttaaatacatcaaatatcctaacattttaaatggagttcctaccaattatattcagagaaacacagtatgaagcatgaaaagtacctatatggaaagtggcttatcacttcatagagatttttagaaagtaatttcctttaactttattgggaaggaggttctactcaaaaactgtttcctggagtagtcagtcttaagctgctgtatgtgttatgcttcttaccaaagttcaggagggcactatctgtttcctcaggatggtgtcaaaatggagtgttggcagtgttccttatgtgaagtaaagagataacagctagaaagctaattaaaatagagtagacttgctttaaggaagcgggcaaaaccttttccttcccagaaaaatttcctactcccacccactgcaaagacttgaaacaatagagtcagcaaaaagaatggcaactttatgttcccttttatgaaatttctaattttgtttccttaagtctctacctcactctatgttgtcttgggtaggtaagaattgacaaatgcttattttcctagtagtggtacatttaaaaacaatctcccttcccctaatgttccttttcaaaaactttattccagccaaaagagtgactttacattgggaggatcttaagacaataacagcgagatagccttagaggaaataattgccttttgtttcatgaatttctctaacttagtgatatcccgattcctgatttgtagcaagtcagaaacactgaaatctccacttaggaacattaataatgtttttcctaattcactggatttgattattgcacacagaagctattcttcccagtatttctttctttctttttgagacaggttctcactctgttacccagactggagtgcagtgacacgattacagctcattacagcctcaatctcccaggctcaagtgatcttcccacctcagcctcctgagtagctgggactgcaggtatgcatgccaccacacctcattaatttctgtgttcttttgtttttttttttttgttacagacaaggtcccgccatgttgcccaggctgttctcaaactcctgagctcaagtgagcttcctgtctcagccccctgaaatgctgggattacaggtgtgagccactgtgccagtatttcccactataatcaagtggtgccaccaccatttggcttatatttctacattaaaagggaagtgaaaagagaaaggacaaagaatcaatcataatcttgggcataattactgggtcatcagaaatgttaaagcatataaggacaaaagaggaagtggctgaaaaagtaaagtacagtgaaaaataaaaggaaataatggggaaaaaactatgactttattagaaactgatatataattagaatgcagatttttggtgagagattagtggtaagaaaataattgtaagtaaatatgtgttatttatttatagccattcttattttaaaaaagatatgtggtggtaaatatttatgtaaatgtcttcctaattgaaaaacacaatgaaacaaaaatagtggcatttctttttaacagtgttgtgtttaacaatggaattgcttcctatctgtctggaaaagtgaaggtatactaatacctcacacttgtataacctttgtgattacagagcattttcccattcttttgattttcataatagcttcattaggtcaatagatcttactctactgtgaaggtgaggaaacagcccatgctgctaaggacttgcctaaagtagcgtcattaataattatcagcaccagaactagaattcaagtctcctcttatttaggatttttcttcaactgtttggtctctcaggtaacttttccaagatcttttccagtttcactagttttagctaatatataaacatgtcataatatttttatagccaaacagtgctgtctgagattttaaatcttgagacttgagaatgcctgaaggctagtgtgctggatattctgtattcattctccattctcctccaccctgctctgggtcctgagagaccggccagagtgaactgcatcagggggcttctggttaggttcagcaggagattggaggctgggagcagagcaagatctggtatttattcctcagctccttccctgctgggccatggatgagtagtggctgtactctttaactgaagatgtagccgaccctctgggccccctacccatgtaccctcagccctcaccattccttatgaatggtggtggcttcttcttttgaaaatacctgccactctctgcctgatggctttttctggccatagaaacacgcttagcccatgcacaggaccggccagaggttctggatagttgctttctccagggaacaccccttaatgaatgatgtgtaggaactggtggataaatttctctctttctgttcccctgagttggaacagctatgagctgtattctacacctgtttcccagggggtccctatcaagacagagccccaaatgctgagtgtgtctaacattggatattcttttagttaggaagaaggtaagaattagaggagtggacatcctttttttttttttttttttttgacagagtcttgctctgtcgcccaggctggaatacagtggtgtgatctcggctcactgcaacctccgcctcctgggttcaagctattctgaagtctcagcttcccgagtacctgcgattacaggcacctgctaccacgcccggctaatttttgtatttttagtagagacggggtttcaccatgttggtcaggttgaccttgaactcctgacctcaggtgatccaactgccttggcctcccaaagtgctgggattacaggtgtgagccactgtgtccggccagagtggacatcctttagtaactgcaacagaggcatgcttcgaatactatacttttttgagacacatgagataattaaatgattgacaacaatactaattaggccagcaatgattacagtgctattgccaccataatgccagtacaaggttggggttattggtggctgtcaggatggtggctgttagagaagagcttgttctgccctagctgtattcttcatggaggcaaagttcttgcaatttttctgtagtgccaacctgatgacacactaaccatgtacgtcttagttacaacaaagctattccacacccagccatctaacctactttgtttctcatctcaggcattactgtgacaatatttacactcagttgtagcaaaaataaaaattttctttttacatatcaatgaaaatttgtaggggctgctgggagggatttgctctctcaaatgcagtggtcgtgaatccccatgttaggtattttaggaaagataaaataagtaataaacagactcttcccttatcaggggaacccgcccccaataattcaacgttatttcacgtaggttcttttctatttccctaagtgttggtcagtcggagaaataaagggaaagagtacaaaagagagaaattttaaagctgggtatccacgggagacacacacatgtcggcaggttccatgatgccccccaagccgcaaaaccagcaagtttttattagtgattttcaaaaggggagggagtgtatgaatagggtatgggtcacagagatcacatgcttcacaaggtaataaaatattacaaggcaaatggaggcagggtgagatcacaggacgggggcgaaattaaaattgctaatgaagtttcaggcacgcattgtcattgataacatcttatcaggagacagggtttgagagcagacaaccagtctgactaaaaatttactaggtgagaatttactcaccgtaataggcctgggagtgctactggagaccagggcttatttcatcccttatcttcaaccataaaagacagacattcccagagcggccagtttagagacctacccctgggaatgcattctctttctcagggctgttccttgctgagaaaaggaattcagcaatatttctcctatttacttttgaaagaagagaaatatggctctgttccacctggctctcaggcagccagacctaatggttatcgcccttgttccatgaacatcactgttatcctgttcttttttcaaggtgcccagatttcatattgtttaaacacacatggttacaaacaatttgtgcagttaacgcaatcatgacaggatcctgagtggacatacatcctcagcttatgaagatgatgggattaagagattaaagacaggtataggaaatcacaagagtattgattagggaagtgataaatgtccatgaaatcttcacaatttatgttcacagattgcagtaaagacaggcataagaaattataaaagttttaatttggggaactaataaatgtccatgaaatcttcacaatttatgttctcctgccatggcttcagtcagtccctcttttccgggtccctgacttcctgcaacattctctctggaactccaggtttggtagtaatggaggatggggtgaggagcgaagagaaattctgtgtgggaagaaatgataacataagtgtgagtggcagaattctttgttaagatgttaattattgtgggttcccagtcctaccctggctcattgtcaaaattatgcaagcttccctaaagcaataaggtaatagggaagaataaaggggtacctttgaagaccaagaaagagtgaaagttttgggtcactgggaagggatgaaggttcatgggtctatgggtaatggggactcttgcctgttctgtggtcatgtcctgctgggtaatacgtcagaaaggacagctgcatggtgtctcagagatgctccactccaagcaccagggcgtccagctgaggcaaagccccctcaccacactccccctttcctacttagcatggggaaagaaaggttgggcagtgagaatatcagatgggatcaagctaggtgtgagattagaaacccttctcccagtttctatagatgcactttccccagattctggtgtaagccaaggaggtaagaggactccagtaatgacagattgagtttcttgccagctcagagagccagagacttgagatgaatttaagttgatataaagaaaataaagagcagaattttttggacacctatatgtggtggattaagatggaacttgctccatgcataaaaaacagagacaaaaagggcagaatatggcaagggctctaggggaggctaagcaatggaatgtatctataataaatcatgatatgttatttgcaatttggaaaccttgcaggctcttctccacagagcttcttccagctgggcagaggaaagaacaattaaacggagaagggggaaggaatgattttctcttggattcttttcttgcttgctccgatttcataacataaagtacagtaacaagtaactgtacatgtagtaaatgtttattagtcaagtatgaagaaaatacttagtctgttaattccttcttttatggtagtcatatgtcacactgatttttatgtcacaaaatccatattgcccatcctccggattatagagacagacacaacattgtttggtgtcagtgtcaaggcatcatggcacacagggtgaagatcccttcgctcttttagttctccatctcacagactcctttgtcattgtgcaggcttcagagcagagacctctgtgcaatttctgtttttcatggaagaaattacagttgggtgggtagggttacaggcattttctacattgaatctgtatttcctggattccaaagcacttgatgaaaatagatttttttttttttttttttttttagacagagtcttgctctgtcttgcccaggctggagtgcagtggcacaatcttggctcactgcagcctccacctccatggttcaagtgattctcttgcctcagcctcctgagtaactaggactacaggtgtgtgccaccacacctggccaattttgtatttttagtagagacggggtttcaccatgttggccaggctgttattgaactcctgacctcaggtgattctcccgcctcaactgggattatagacgtgagccatcatgcctggcaaaaatagatttttagtgtttggaaatcaagatgtgtctttcagtcaaagtcaaaagaaatctatttgtttccagagaatctcaagttatactgtgtttgtcattgtgcacaagtatgcgtagtatttcatagaagatatcatttaatctgattgccaaagcagataagttatttgtaacagtagttgatgcaggtaaattttaattaaattctagacctccaattggcttttaaaaccttttaaatatttaatacaattatttatttatttatttgtttgtttgtttgtttatatgagatggagtctcgccctgttgcccaggctggagtgcaatggtgcgatctcggctcactgcaacctccacctcccgggttcaagtgattctcctgcctcagcctcccgagtagctgggattacaggtgcgcaccaccatgctcggctaattttttttatctttagtagagacagtgtttcaccgtgttgtccaggctggtctctaactcctgacctcaggtgatccacccaccttggcctcccaaagggttgggattacaggcatgagccactgcccccggctgactttagtttttaatatggaagattgcctgttttagctgaacaatgaatttgaaaacaataggagttgttacgtactttggtctattttagaacattttcaaagtttttttttttttttttgagacagagtctcactctgttgcccagatgggagtgcagtggcatgacctcagctcactgcaacatccgcctccctggttcaaggaattctcctgcctcagcctccagagtagctgggattacaggctcatgccaccatgctaggctaatttttgtatttttagtagagatggggtttccccatgttgcccaggctgctctgaaaactcctggcctcaagtgatccacctgcctcggcctcccaaagtgctgggattacagatgtgagctgtcgtgcccagctagaaaattttcaaagttttgagcaatgtgtgtgaccaattcgtgtgctgaggaggagttttgcttgggaatggtacatctattaaaagtttctagctaaccttttcccctaaaatgtttattaaaatgtttaatatttaatagaaataatatgaaaatacataaagaaaaagttaataaactcctttcccacccctccagccattttctcttctgttcctccctcagaggattcttgttcatcttttttcatgctcttgcatgatgtgcatatataggtttttgttaaaatgtagcaatgatggttgcacgcacaccccttcagatctcttcactatttctgtgcactccaactcctggtgtagttatcctcccaacagcccagccctgcatcactttatgagcaaatgaccctcaggttactggaatgtgcttcatttatgcacatcgggggccataagtgcctttgaatttatgcttccaccccccaacccttaactaatgactgataggtgcaaaaatataaacttcagctcttgaccccctcatcagtataatttagtcaattactcccagtagtttctcagctttgttctgctttctgacactaaaaacaatgctataatataaaactgtctacatatattctatatatttaccaaaagtaattttgtctgtgtgtgtgcatgaaagagagcctccacttgagtctactgaagttgaactaagccactttctacaatattgagataaagtagtggagctagaagtatgaagaaggatttatggggggttaggcaaatgaatctttgtcctctcaacaagtatttactgttttcctactatgtgcaggctctgtgtacagtctactattcagtgcaggacaaaacagaaatggttcctgcccttgtggagctcgtctagtgggggagtaagatattaagcaatgatgtcatatgtaaatctttgcaaattgaataagtgctatgaagaatgaatagaaggtgctctgtgagagttaattgggggcctaatttagaaatggaaaaacctctctggagaattgacagtagaaaaaaaaattaaaactttttttttttttgagatggaatcttgctctgtcccccaagctggagtacagtggtgtgatctcagctcactgcaaactctgcttcctgggtttgagcaattattctgcctcagcctcctgagtagctgggattacaggtggctgccaccactcctggctaatttttttgtatttttagtagagacggggtttcaccatgttgtccaggatggtctcaaactcctgacctcaggtgatccacctgcttcggcctcccaaagtgctgccattacacgcttgagctgctgcaaccggcctaaaaattaaaacttttccccaatgtttaaattatttacacagccctaaaattcattctaaagaattttgttttgtatttatttgaattgaatagacttggaattgagttttgctctaaattgcaatgactgtggaacagccacctttgttgcagaattcctctcaaacccttatgatggaacaacagaaaatctataactatgataggtggccaaattagctggaaaaatgtttgacttgtaaacgtatcatgctggggtacctggagcatctgaatcccaccaccagcaccaccactctgtaagaggaaaacctggtggaacaaatcagttgagggctgggacttctgggtagggagaaaggaagggagggaagatgaaggagaccaggagaggatcccaatgttctggaaaagtccctggcatatggtaggtgtccagtaaatatttattgaataaatgattgcgtgaatgatgctcagcagggatatggatactgagctcacatggactgctcagtagcctcatagggagaaaacactgttttgcattagcccctggaatctctgtgtgtgcatggttgtctggtgattagattggtaatgtcctgtgcctgccttgatttctagatggtaagggctcagataagaatatgaaccagcttttaccaggatggggtaattgtcagatattaatgaagtatggcagtaggcaaacctagggccaaaactgaagtgagggaggccccttgcttggccagatcaggagtcactgtccaaaggcttaggtcccatcattttcctgcaccaaagctggatatagtgggcagtcagcagggagccaaggagttgtgtgtggtcagggtcaagaaaggcaaaattcgtcagagaaatgcataccctgttggtgagatggagaagacctattccttctcacctcaaaccaagactcaccataaataggctatgcatactcatgatgatctgactattttgagtagcttgccagaagggtaagatgagaaaagagatctaatttacactttttaaaatgacaattagagggagatcacaacagccaaagaagattacctatttattaagcacataggcacactctggtttaggtgctgtgggatgttgaaggatttagatgaggaggagagaaaaagaatttgcactcagactcgagaatttgaagtcacactttggattgtatacacaggtatacttcagagatattgcaagttcagttccagaccaccacaataaagcaagttacacaaattttttggtttcccagggcatataaaaattatgtttacattatattatacattatattatagtctataaagtgtgcaatagcattatttgcaaaagtacaatgtatataccttgattaaaaatactttattgttaaaaatgctaatgatcatctaaaccttctgtgagttgtaatctttttgctgttggaggattttacctctatgttaatagctgctgactgatcagcgtggtggttgccgaaggttggggtggctgtggcaatttcttaaaagaagacaacagtgaagtttgccacatcaattgactcttccttttatgacaatttctctgtagcatgtgatgctgtttgatagcattttacccacagtaggactttcaaaattggtgtcagtcctctcaagccctgctgctgctttatcaagtaagtttatgtaacattttaaatcctttgctgtcatttcaacgatgttcactgcatcttccccaggaatagattccatctcaagaaaccagtttctttgcttatccataagaagcaagtcctcatctgctccatttgtatcatgagatgtagcaactcagtcacatatttagactccacttctaattctagttttcttgctatttccaccacatctgcagttacttccttcactgaagtcttgaacccctccaagtcatctataagggctggaattgacttcttccaaattcctgttaatgttgatattttcacctcttcccatgaatcacgaatgttcttaatggtatctagaatggtgaatcctttccagaaaatttttgatttactttgcccacatccaacagaggaactatctatgatggctacagacttatgaaatgtatttcttaagtaataagacttgaaattacttcttgatccatgggctgcagaataaatgttgtgttagcatgcataaaaataacattcatcttcttgtacatttccatcagagctcctgggtgatcaagtgcattgtcaatgaacagtaatattttgaaaggaatattttttctgagcagcagccatcaacagttagcttaaaatattcagtaaaccatgctgtaaacagatttacagtcatccaggcttttttattccagttacagagcacaggcagagtagctttaacataatcctttttgtttttgagatggagtctctgtcacccaggctagagtgcagtggcatgatcttggctcagtgctacctccaccttttgggttcaagtgattctcgtgcctcggcctcccgaatagctgggactacagacacgtgccaccaagccctcctaattcttctgcatttttagagatggggttttaccatgttggccaggctgggctcgaactcctaacctcaggtgatctgcttgccttggcttcccaaagtcctgggattacaggcgtgagccactgcacccggcccatttaacgtaattcttaaaggccctaggattttcagaatggtcaattaacaatggctttaacttaaagtcaccagcttcattaggccctaacaagagagtcatcctctcctttgaagatttgaagccaggtattgacttctcctctctagctatgaaaaactctactggcccccagaggatgaagggcctaatgtggcatccaagatggcatcttcttccaaaagaaggctatttcatctacattgaaaatctgttgtttcgtgtagccactttcatcaatgatcttagcatgatcttctggatacctcactgcagcttctccatcagcacttgctgcttcaccttgcgcttttacattacggaggtggcttactttcttaaacctcatgaaccaacctctgctggcttctgacttttcttctgcagctttcttacctttctcagccttcatagaactgaagagagttaaggtcttgctctggattaggttttggctcaaaggaatgttgtggctggtttgatcttctatccagacctttcagacattttccatattagtaataaggctgtttctctttcttatcatttgtgtgttcactggagcactgtgtttactttttttaaagaaattttctttgcgttcataacttggctgttttctgcaagcagcttagcttttagcctgtctcagctttcgacatgccttccttgctaagcttaatcatttctaacttttgatttccagtgagagatgtgtgacttttccttttacttgaacacttacaggccattgtaaggttattaattggcctaatttcaatatattgtgtctcaaggaatagggaagcccaaggagaggaggagatagtgggacagacagtgagtggaacaatcagaccacaaacagcagttatcaattaagttcatcatcttatatgggcatggttcatggtgccccaaaacagttacaattttaatatcaaacatcactgatcccagatcatcataagaagtataataataatgaaaaattttaaatattgcaaggattaccaagatgtgatacagagacatgaagtgagcacatggtactgcaataatggcactgatagacttgttcaatgcagggtcgctacaaaccttcaatttgtaaaaatcgcaacgtctgtgaaacacaataaagccaagcacaagcaagtggagtatgcctgtaagaaacataaaatatgaaaaatcagcagtgtgaggcattaagcagttcccaggttgcttggcacttatgaaagtctcttagaatttggaggagagagggttagctggaagacttgaaagattcaaggtttgagccagaccctgaaggatgagctgagacaatcatcttaggttaagtaatgatctcaaaagtataaaaattgctattactattatctttttctgttttcctatttcttcagactttgctgcccccagaggatgaagggcctaatgtaaaggagaacaggaggcctgattttggcattacctcaaagatttgtcacccctggctgatctctgcaaaggcggaggcgttaacagcaacataggagcttcctgctgtagactgttctggtattgtgggatattattgtcctcaaaagctgggtgtgtgggccatgctgataaggtcatcggcattagtctaagggccatgtgttcttcaaaactttccactgactcttaggcccagcaaggtccagaagtagaagacagagatttatgctgtttggagtcttgattgcttggcaagtattaatacaattctggggcacttaacggttggttagtgtagtaaattttgcttaacactagcttttctgcatctcagagctactttaagttgtctggcaatgttcccaaataagggtaaccccgtctggagaagcctaggccttttccttccttttgttattttttttttcaagtgctgcaaccagcagtcgctactccttcctgtcctccccctagagttgctgactgctctccagtgacatgtatttggaaactttttaagatactagaaaatcaacttagaaactttctttttctttttcttcttcttcttctttttcttttttctttttttttttttagaccaatgggaatattgtgtgttgtggatggaaagatttgaatactactatgttttcacattgagttcaatgtaacaaggccatttccgtgtcttggcacacagcctgagttaactttgctttgctggatgtggatacaatgaattctgtttgaacaagaaatcatgtgtaacaaatgcttttgcaaaatcatgtcgtcattaaagcagttactttaataaagatgggcttcacaaggggtttccggtacaacagctgcagttaaatatctatacactgttaacatattttttaaaataagcttttaattatagaatagttttcaatttacagaaaagttatgaagatagtacagaaagttaccaggtactctctacccagttccctgattattaacatcttacattagtgtggtacatttgatacaataaatgaaccaatattgataccttaatatcaactaaagtccatactttattcagatttctttagtttttacccaatgttcttttctgttccaagattccaaattacatttaatcttcatgactccttaggctcctcttggctgtgagaatttctcagactttttatttttgatgaccgtagcagttttgagaaatactggtcagaaatttttgtataatgtccttcaattgggatttgtctgatatctttctcatgattaggctcgagttatgcactttttggaggaagaccacagagtgccattttcatcacatcataccaaggatatgtgttatcaacatgatttatcactgttgatgttaatctagatggccttgctgaggtagtgtttgtcaggtttttccactgtaaagtcactctttcttactctttttctctgctgcactctttggaaagaagtcactatgcaggccatacttaaggagtgaggagttatgctttacctcctagagagtggagtatttatgtaactcatttgaaattcttctgtatggatttgtctattctctcccatttgtttatttaataattcatttgttaaatattctatttcataaatacactaatagtctatttcagtatagactcgtggatatttattttatactttggattatctttgaatatggttctattttattgttcaaattattctaattttggctattggaagctctattggctcctgtgtcactttgacacaccccatcattgtaagctttttttttcttaattactttctggccccataagatactccaggattgtcttgtaatatttcctgtccccagcctagagtcacctatttatcaggggaattctggttccttttactggagaacggttatagaaacaaaaatctgggggttagatgtgcttattgctactgcagtatcattgcttataggcccactctgctgacagagcaagaaaatatagatgtattttaaaccatatatatatatatatatatatatatatatatatatatgcacaactataaatagttctacatttattcatatgtatccctattaagctaaacctgagttcatactgatgtctctaacgttaatccattaccacatggatcattctagccatttccccttacttgtctataaccttccactctaacagtgagaagcctgactcctattgtctgtcatccatttacataatttctgattccagtatacatgtatagtggtttcagaattatgaatcttgggagacagagtaatgtacttttacacagttccttttgcctttggtcctgtagactttactcacatctaaagtgacttggggccgagagtggggactcatgcctgtaatcctagcactttgggaggccaaggcaggtggattgcttgaggccaggagttcaagaccagcctgaccaacatggtgaaaccccatctcaactaaaaatacaaaaattagccaggcttggtggtgtgctacttgggaggctgaggcacaagagttgcttgaaccagggaggcagaggttgcagtgagccaagatcatgctactgaactccagcctctgtggcagagtaagactctgtctcaaaaaaaaaaaaaaagtgactaggtcagcacccttttcctctacctccctctgtgaggttttttcacacatttgtaatacagttccattattttgtcagaatttaaatttcattctgggctcccttgacttcctgaataatttttgaaaactttgtatgggttaaggttcattctttgtgatttaaatttctgtagattttgacaaatgcatattgtcatgtatccaccattacagtatcatactgaaaaattttatcaatctgaaaatatcccctctgctttacttattcgacctttccctaccctgatgaatctttggtaatcactcatttatttattgtctctctttaaagtaagcagttttttaaaaaatttaaatttttaaaaatatttttaagttttggagctctaataagttgattggtctttcatagataatgagtactttgtttgaaaatgagtatctttgaccttaaagaaattatagcttttatcagttatacttgcaattcacagatttggatttgtgttttgaagcagcaataacatcttactttttttaaatgtttttttatttttagaaataaggtcttgctctctttctcaggttggagtgcagtggcacaatcatagctcactgcagccttgaactcctgggctcaagtgatcctcttgcctcagcctcctaagtagatgggatatagacatgagccaccatgcccagctaattttttaattttcattttttaaagacgagatccattatgttgtccaggctggtctcctggcctcaagcaatcctcctgaattggcctcccaaagtgctgggattacaggtttgagccactgcacctggccaatcttaccatttttgatgaagtgacagtcacttattatctctgcagacctttgagacatttagacaaattgaggcacttgatgtgggagtaggataaaggagttaaaggggatatttcaacagaacatttatgtaagagaatccactcatgcaaggcaagagagaggaagtagttatagctaaaaaaactaaggtaatgcctacacagcactgacttcattgagtactagcattgggttagatatttgccgtagcataggatcttcatttcagttcagcaaactctcattgagtgtctgctgtgcttgaagctgctgtgctgtgtactctaggcttaccttctcctgctgccacgttgggttgtagactttcactttggaagagttggccattctgccacattcaagggcttccccaagctcagttagggcattcctccctgactacctggaaataggaagacatgggtgatctcatgtcatacttcactccctctcccaacatggcctcagtcccacagctgctggttgaatacatagaatcacttaactttgggaaaaggggtggagaggccctttgtgctatagaagggaaaggactttgactctcatttccttcaagtaccgttaggttacttctgaaaaataagtggaagatatcagagggggaaaaagcaagagacacaagtacaaaaggcaatgttttgtttaatctgaacatagattagtgcatagtgaagaggaagagaactcacccttactgagtgccacctatgtgccagagtctgtgttgggagttctcacatatttattctcttttttacctccaacatggctttgtgaagtagattaaaaaaaagacctttattttatggatacattggggttcagaagggctcgctaacttgtctaagatcatacaaaaagaattgaatccagatcttcttaatgctctggcagcactctaaaatcatcttggcctttaaaaaaaaacgtggctgaaacctaccccaaactcaattaaattccaatctctgagggttgggatgggcattagtattttttataattgggccaagtgattatagtgtgcagctgaagttgagaaccatggctctgactaaagaggcagtgccactcctactactttccacaagaagggacggggcattttttgaacgagtgtgcattctaaatactcttggaacactttcagatccatccctttttctctgctcctcctaccctgcaccacagtgtccttttcatctctggatatctgtaagtaagcagatggaatgagaagagaggttgttattgatagtggagaaatacaaattcaattgaattaatttaatcagcattcctcttttgataaaacacgtatatgtagtgctgatagactgtcaaagcacaatgtcaagtagtgtcaagaaaatttgatacagttttccaaatttgttgacaactttggtttgttgaatatgcattcaccaacaccaaatagtactgacttattatcttggtttgtagggatcataaaaaagatggggcatggatctattgctggtaggaaaataattttgaattcctgagattagatttgttaattgccatataacatgtaacattttaccccaagatttttgaagtattgcgatttaccatatctatggcatctcaattataaaaatccattattttacagtctccttttaaccttgaaattgaccatgagcatcataatattttgattcaaatcaaaatgttcaaatgtcataatattttgaacactttgacatacgttatgaagaacctcttcgtatattcatctataactaaagttgaatacataaacacaggcattcttggaattggcaaaacatgtcatttcatacaatagttactttgggcatttattttaggatacgtaaaaccagagtaccacctctcatgagttttatcaatagaattctgttttaatggagaactggaaacaatatagagaacagaatgctcatcttccaccctatccgactagctctgtcctttctgtcccccctatctggcccctaatgatgcagaaactaccattactacttagtccaatttatgtggttcctgcttggtcactgttgggtttatggagtgtgccttaaaccatcaaaccacaatagcatattgcatattggacattgtgtatggtccttcctgatttctacatctgatgttaagttccacagggaaatctaaggaaaccttgatattgctgcctgattattacacaacagacaaattgcatggtgaatatacttttcttgcttacactggtttaacagttttttttggctttgatcagtttattgttcaattacttatatttttctggcaaatgattttttttttttttgaagtggagtctcgctctgtcgcccaggctggagtgcagtggcaccatctcggctcactgcaagctctgcctcctggattcacaccattctgtcacctcagcctcccaagtagctgggattacaggcatgcgccaccatgcccggctaattttttttgtatttttagtagagacggaatttcactgtgttagcccgggtggccttgatctcctgacctcgtgatccgcccacctcggcctcccaaagtgctgggattacaggcgtgagccaccgcacccggcccaaattatttcttttttctatttgcccctaaagtgaaatagcctattttgtgagtatcatcttgccaaattatagcattatttttaactacccaagtccattttgcatatgtctactgactcaggaaatattcagttacatttcttaaataacagtaataataccccatataaccactgcatatcatcaaataatctcccactttttcaccaggattcttttttgccttttattgcaaaaaatttcaaacatagaaagtagagagaataataaaacatatccccatataccatccagcttcagcagttataatgtcatccctaatcttgttttatctgtacctcacccattcctcctctttttgaaactaatctcagatttcatctgtacatatttctgtgtgtgtctccagcagataagggctttggaaaaattatagccacaatactactatcataccttaaaagttaacagttctataatattataaaatatctagtcagttttcaaatttctttgattttctttaagtttcttttacattggtttgaatcagaatttcaaggtcctggtattaattttattggtatatcttttaaatctcttttaatttataggtaactcattctcttttttcttctctgcagtttatttgttcaagaagttgagttgttttattgattgttttagtctagtctcctacaaactggattttactgattgcattcctgttgtatttttttaacgtgtttatccgtgccctcttttccccacaaactggtattaggtttagaagcttccatttttgggaagacagcttcagaggatgtgatgtgtgcttccatcagaaggcagagaatgaatgtttatacccccttttgttatgtgaacagtcattgatgattattgtttatgttcattcctttgtgaggtattgcaagatggtgatacccaaatgctaccaattttagtctttcattatctggaatactttaaagacacttttccccatcaatgattttgttgtcctggggtacattttgtgcagcaaagggaggttgagtgttgctattatcccccttgtgtgttttcacaataatgaattcgttctaaaggtgaacagtgatttcttcatagggtcattatgactatgtggatctcaatatatctgatacatttcaatccattgcagttattctttttattgctgctcaaatgtcttcttttcttatactttggccagtaggagccacttaaagttagctcctgaatccttttgacacaaccctagtaattttagatagtgtccttgctttctggtatacctcctgccccagacttggttagctatttttccaaagggccttaggccattttagtagaaaatagcatttacaaatagccatcttggtgctgggatagaaggtaatgatttagtaaaaacctatagggaaggagggaatgagccatgtggatattcgggaggacagcattccaggcagaaagaacagcatatgcaaagacttggaggctagagctgagggagcaagaagaggacagtagtaggaaagaaatagaggtgaccaacttcctggtgggaagttggaaggactttggcttttcttggggtgagatggagccttttataaattttgagcaaaagagttccataatcttttgttttgtttaatttttaactgaattattatagtttctgggttgaaaataggctgaagagtttgaagagtagaatctgggaggagaccagtgaggaggctatcacaataatacaggatacaggtgagagatgatgtggcttggatcagtgtggtagcagtagaagtaataagaagaggtcaggtcctggatgtatctggaagataggaaccgctgaatttgctaaaggattagacttggattgtaaggaaagaggattcaaatgtgactccaaggtttaaggcctgagatgttaatgaaattataaaacatgataacacgagtggcatctcttttgtgggtcagcacagtgtttgtgtctgtgggaaaggagcggggatgggtcaggcaaaacttcacgggggatgatgtggtttggatatttgtcacttccaaatttcatgttgaaatgtgatccccaatgttggaggtgggacctggtgggaggtgtttgggtcctgggggcagatccctcatgaatgacttggtgaaaatgagttcatttgaaatctggttgtttaagagtctggcacctcccctttctctctcgtgctccctctcttgctatgtgatgtaccagctcccccttcaccttctgccatgattgtaagtttcttgaggtcctcaccagaagcagatgctggtgccatgcttcttgcacagactgcagagccatgagccaattacctctttataaattacccagtctcaggtatttctttattgcaatgcaaaaatggcctaacacaggggaccagatatttgagtcatgaaagatatataggaggaccaggtggataagaggggaaacagcattctgagcagggtaatagcttgtatacattcagagttgtggccaggcgcggtggctcacgcctgtaatcccagcactttgggaggccaaggtgggcagatcacgaggtcaggagttcgagaccagcctggccaatatggtgaaaccccatctccactaaaaatacaaaaattagccggccatggtggcacgcacctctagtcccagctacttgggaggctgaggcaggagaattgcttgaacctgggaggcggaggttgcagcgagccaagatagcaccactggactccagcctgggtgacagagcgagactccatctcagaacaaaacaaaacaaaaattcagagttttataaggattatgggtcctggaattagattcagtttttggagtgcaggaagcctataacaggaaatgagtttagagaggtagagagagtccttacatattcgatgacaggaatttaaattttattttatgcatgataaggagactagaatttttaaagtctgccaatgacattatcagatatcgatttcagaaagatgagagagtatgcactatggcagaagtgacgagaatggagagaggagatgaatttgagagatcttaaggtatagaaacaattggatttggtaaacaataagatgtgggatgtggggaggggtctaggaggaccctgaggttgctgggttgtgtgactaggtggatggtagtgccattatctaatgtaggggttgggcgcagtggctcacgcctgtaatcccaggactttgggaggccgaggcagcctatcacctgaggtcaggagttcgagaccaggctggaccacatggcaaaaccctgtctctcctaacacaaaattagccaggcatggtggtgtgcacctgcaatcccagctactcaggaggtggaggcacaagaatcgcttgaacctgggaggcagaggttgcagtgagtcaagatcgtgccactgcactccagcctgggcgacagagtgagacatcgtctcaaaaaaaaaaaaaaaagtagggaatactggtactggatgggagcagatttggaagtaaagatacagagtacagtttggatgctaagtttgagctgcttgtgggatattctcttgacacccagtaggtggatggaaatatggatctggtgctcatgggagtggacttggcagaaatgtaaaggcataagaagttatgacctaggtagaataagtgaagtagggagagaaggcaaagggtgaaggtctagggaataccaacatttacaagacacaaaagttgactgaaaaggagccatcatacacagatggaggaggaaaatcagacatgaggggggttctggaaaataaggagagatcaattttcaagaaagaaggaaggccaacaatggcccatgctacatagatccaagaagataaaacacaaaaattggtctttgctttacaggccattggcaatcttagggcagtttcattggcatggtgcggtgagaaacgggaatgcaatggaaggaggagtaaatgaatgaggagagaatggaggtgatgaaggaaggcaaaggtagaccatggtctcaagtagcttgtttgtgaaggagctgtttttgttttaattaattttttaaaaattgtgataaaatagacataaaagttactatattgctgggcccagtgtctcacgcctgtaatcccagcactttgggaggccgaggtgggcagatcacctgaggtcaggagttcgagaccagccgcctgaccaacatggagaaaccctgtctctactaaaaacacaaaattagctgggtgtggtggtgcatgcctgtaatcccagctactcgggaggctgaggcaggagaatcacttgcacccaggaggcaggggttgcggtgagccgagatgctgagatcgcgacattgcactccagcctgggcaataagagcgaaactctgtctcaaaaaaaaagttaccatattaatcatttaaaatttatttttatttttgtagagatggggtcttgttatgttgcctaggctggtctcaaactccaggcctccagacaacctactgcttcagcctcccaaaatgctggggttacacggtgagccaatgcacctggcccatattaatcatttttaacagtatacttaagtatttttaagtacattcacattgttgtgctgccaatctcaagaatttattcatcttgcaacactaataattcataccattaaacaacagaatttgtttttaagaatgagaatcacttaaatattttatatgcatagggggatgaaccggtacagtgaaagaggatgaaggtgtaggaaaaatgaaaattctaccattctaagaactttataagaccatttcatcattaaaagacagacaaatatctttacccctttctgacaactccttccatctttctgagtgcagttttaattttctactttctattacaaaaaaaaacaataaaattgatgataattttttgttgagaaagacgatttattttttaagataaattctgaggcctttagaaagatacacacaaactcccatctcttttataattattcttgtatgaattggtgataatatatacttaaccatagtattttcatgatgctgaggagggtgcgaacctggacaacgtgattaaattgtagcacagagcatattaccataaaaagcattaaatgttgtcaaaaggctcatgtaatatgaattaggggttaaaactatgtttctattactccatattcagtttggatgaacttcaaatatttatgaagtgctagttactataatgagattttacctctcctggttaaaccagaagttgggtactagaacaatttactttttactaactctttctctccctgatgaaatgtaaagagaatgagacaattgtcaaagtaaccttttgtcgacaacgtctgatacaacatgactgaagtgaccttgaattttaattttgtttaaaatagagaactgtggctaggcactgtggctcacacctgtaatcctagcactttgggaggccaaggcaagcggatcacttgaggccaggagtttgagaccagcctggacaacatggtgaaacccaatctctactaaaaatacaaaaattagccaggcttagtggtgcgcatctataatcccagttacgcgggaggctgaggcacaagaatcacttgaacctgggaggcagaggttgcagtgagccaagatcacgccactgcactccagcctggatgacagagtgaggctctgtctcaaaaaaaagaatgtaagaacgtagtaaaataggccaggcatggtggctcacgcctgtaatcccagcactttgggaggctgaggcgggcggatcacctgaggtcaggagttcgagaccagcctgaccaacatggtgaaaccccatctctactaaaaatacacaaattagctgggcaaggtggcgggcgcctgtaatcccagctacttggaggcagaggcaggagaatcacttgaacccgggaggcagagggtgcagtaagctgagatggctccattgcactccagcctgggagacaagagtaaaactcttgtctcaaaaaaaaaaaaaaaaaaagaacctaatatcctaatgtaataaagtagagaaccgttgccacagcacccaccaaagtgtgtctctcattgacaagctcaggtacttgtttgtctgtttctcctgcctacccctcagccactctggatcttccctttgatcattcttttctctttctagctttgatgttttggtttccattctgtaattcgcacactattttgtggacatgctcttttcaaatttctctccaaaacaatagtacaaaggcagtcataaaccaattgttggtttttacaaaaaatcccatcatatcaccaaaaaccagttttatcataacaggatgaatatcagaccaatattcattattagagatgtagtctaaactgactcgggagaagacatccattgagtctttcattcagtgtaattagttgttatcatacatgcaaaatcctataactataaagcatttcagaaataaagtattgttaaacagctccaaatttattaaagtataaaaaatgtattgagtatataccatgtggcaccgtgcaaagtaacagagatgcctaaactaaaaggttatcctttgtccttattaaagtatgactgaaagctcgctggagaatatagtttctacatagagtcaaaacagtccttcgggctcacaaatttaatgatttatatggtataactggctttagatacaaatttacatgccagacaagcaatgtagaaaaatcaagaactaggaaacaggaaaacagatctacatttctgctttgctgcaattcattcatttttttcaaccattcatcaaatatttattgagagcccatgctgtgagagaaactgtattaggtgctggggaacatggtagcaaataagagagaccatgtatgtgagcatgagcaggtggcttaacctctccacatctctaacctcttttagactcaatgtctgaggtatctttcagacctgaaatgctaaggtttgcaacagccttgtggagggagaagctgccaagtcgccttgggacttgaggacttaccttcctttcaaaggattagcccttgttttgatttcaaaataattttgttacacagtttaaaaataatttggtcaggctctcatctacattggggtaatcttgacggtctggatgtggtaattcatgctcattagacttcaaaggtaggaagtcaaagttgggaaatggtggatgactttcatcaattcatagccaggcagcggttcccattgagcagctcctctgtggttccacccagccttccaaccaataacgcagcgtctcctgcaggaaactcatcgcttgggtcacctgttgctctttgctctaatgagccttgagaaaggattgctggtcatgggaccagaggctttatggggagggaagaactgttcttgactttcagtttttcgagcgggtttcaaggtaacaactttcttattatctagcttcataattgcagtaaggaatagctttttttgcttgcagctgagatgactttttcaagggagaaaaagggatttctataacgaagagagggagagagagatgaagagggagggagtaagggagagagggaagaagggagaaagagagagagatttgaatatacattgcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaagggtaagaccaaaattgatttgatctgaatccttaagaaaaaaaaaatagaaggaaaaataaaagcccagaccaaaaagcaagtacttgaaagctggaggcaaaaagccctgaatgaactttcccaccctcttccttctgagaggaggcagagaaagagctttgggaaactttttaggaagcagagtccagggttgcagtcaagggtggctctagagcaagctggaggggctcatgaatattcattatcaatttgtattcagagttggtttttttagaggcaaatgactttttcagtccccttgcagtttaagaggcagctgcctcatctgcagtccggactcatctagcctcgggtctgtacctcagggtgtttgcttgaagatgctgggctctgcgtgtagatttgttttgttctcgaatttcttgcatgctttcctgttgtgaaattagcaaaggcttctttgctgggaacaagacagagaagttaatgtggcacaaggctgtcacaacaggaccccagagtatgtctttcaaaatgctgaaagtttcttgagatatgtgggggagttttatgtgggggacagagtgggggacggggacgggtagagggaggaaatagaataattctatcttaaaagggcaggtcacatctgactacatttagattttgtctaaaaactacaagagcagcctggtttgcacagatggtgtgcagtctctatcttttacctcttttgggcattttctgccaagacggagagccagctgcttgccagcgtgtgagagccaggaagaatctctgcagcagtgagggagtatagggttgtaaacctccttctcctccttctttatcatctctaacttctaacattcccacatgcttataccgtatagaacatggaagaatagcatgagtagccaacatatttcttaatacttacaataatgatagctgttaatgttgactaagtctttattctgtgttgggagctatacctagcatattacatgtgctacttacttgtcacatgaaccttacaagtgctatcattgacattcccattttccagatggcataattgaggtactgagaggataacttgccttgagatctcatagttagtaagggctgagtgtggatggaggtggtctgaggcagggctggtgggcttttccactccccaatactgtttctctgctttttctggtgccctgacattgtggatttcaggtttgcaaatccttgaagctactggggaagtgatactggtaaaatcttaagtctgtgaaggaatttgtactttgcactcaagttcacatacattttcctcatttggtgctcatggccattctctatgagaagcaggtattgttattatggtcttttgcaaaaaggagaaactgaggtcagaaggggttagtttggtgacaccagtcacagctagttgtcaaaagtctggactggggggctggatgtggtggctcgcacctgtaatcccagcactttgggaggccgaggtgggcggatcacctgaggtcaggagttcgagaccggcctggccaacatgatgaaaccctgtctctactaaaaatacaaaaattagctgggtgtggtggtgtgcgcctgtagtcccagccacttggaaggctgaggtaggagaatcacctgaacccgggaggcagaggttgcagtgagctgaggttgcaccactgcactccagcctgggcgagagtgagacactgtctcaaaaaaaaaaaaaaaaaaaaaaaaaaaagatttggactggatctgaaaccctctgcttctggtttttcttccaacctacagagcagacccagtcatctctgaacgtctgtccccaccccaagctgcgcctcattgagttgctttcagttccccaaaggaactgcatctttcctcagactgaagctaggcactttcttctgttttaagggcctatctggtactctgcttcccctttagtctggagccgagctgcctgggtttgaatttcagctccaccatttactgtgtgccttagtttcatcatctgtaacatgaagagaataacagtaacatctatcttacagggttgtggtaaggactgaatgagggattcatgcaaagtttttagaacagggcctgatatatagtattgctaaataaatattaacatttgctatcactgcttgaagcctcatattgggtgttattcccctttaagccttctctaatccttcaagtctagattagcccccatcttggatgcttctatagtacctcatcagttatgcctaaggtggcactcatcatacttgtccatgctcctgccctctgcatcaccttctctcccttccaattatattttctgtattcacctttagatctgcagtgtctagtgcaattttatttttagtctctaaacttgtggcaactttctcatcagtgtgggcagagtggtgggagaggggcctcagtcatgataggggtacaggaggtagccacagaggatgaccatatagcagtcatagagggccagaagccacgcaggaagtggacatatgctgagtactgattcaggaagagcacatgtcattcagcaaccaatggttaaggtgtcaggtttcaatgaccttctccatgaggtctgtgaggtcctctgacgtacttattgtgggtcagcttggcagccacattcatcagcccctgggacaggttcttgaatttggtgttcctctcagagaacatcccaagctttccttagaaggtggtacacaccaggctcttgtgcaagtccaaaaggtccttgtcagccattagcaccttgagttccctaatgggaactcaataaatatttagtaagtgaagtattattattttagctgatgctcatttgagaccttcaagaggcttgtttaaaaggggacctttgagtttgcagtagggttccccactggtacatatagatctttggcacaatctgtaaagacgtccctctatgtggatacactgaaaaacaaaatgcatccctctgggtggatgattttcagagctaatgtaaccccatgccagggcaccctgttgggcaagtgaagctctggctgaacttcagcccctactccctgctcagccaagggccaaactggagatttcagatgcctcatagccaactttgctttctctgaacagaacatctggttccataaatagtgtctttctagccctactttatagcaaccttgctgtctgagataatgtactctggtaatgaaataaaaacaaacactacagaagttggccctgggaaaaatcataaagtacgctatggttttttccagcaccctccctttcctcttcctggcataccttcaaaccattttgacaaatattattgtgtgtctaccatttgtaagttcccatgccacacagatccttggataaacagtttgctcacggtctagtggggaagcctaataataatagctgggaagtgctaataataatagctaacattgatcatttattatgtgccaaacattgtaatgtgtgttgtctcatgtaatctttacaaaaattccatgatattggtttctgcatcttccagctgtggaaggaggtcatttggttaaggccacacagctaataataggcagaggggaaattttgactgatgtggttaggctgcaaagtctgggatcctaatggatacgttctacctcctcaagagctgtaatgtaagtctaaacaaagtgccatgacacagtggtgcacgcttgtagttccagctactcaggaggttgaggcaggaggatagcttgggcccaggagtttgaggctgtaatgtgctatatttgcacctgtgaataaccactgcactccagcctgggcaacatgatgagactttgtctctaacaaaataaaaataaaaaataataatacaagagaaagtgccatgagaagcagaatagggagcgatggcttctggagaaacttctcaaaggataggacacttcagttggatctagaaagatgagtagaatctggtgcccatggcaagccccttcaccctcccagcagtgcttgaagatcttttctctcttttaccttaactatagtgtagatttaagagtaaaaagcccccttttttcccaagctctgagcagtcaacctacttacatgtccatcttggagatttgaaggcagaagtacagagtttatccttcactatgggtcgtgtaatcaaataagcctttacaaagcaatcagctgcacattaaatgatttccttaatcatgattgcactgcggggtaataacatacatctggtaaacagtttttataaatcattgtgattggtattgcctttacttggtcaaattgcattttgagagtgctttccctcttgtgttgtctttttggttgtttctccgctctttataactggtaatggtgctgaagggcactagtgtttaatcgcaccaactactgtccagaggtgatgggctccatctgtgtagagtgaaggtgaggcctggagtaaattacatagagtttattctttttttttttttttttttttttttttttttttgagacggagtctcgctttgtcgcccaggctggagtgcagtggcgcgatctcagctcactgcaagctccgcctcccaggttcacgccattctcctgcctcagcctcccgagtagctgggactacaggcgcctgccactacacccggctaattttttgtaatttttagtagagacggggtttcactgtgttagccaggatggtctcgatctcctgacctcatgatccgcccgtctcggcctcccagagtgctgggattacaggcgtgagccaccgcgcccagccatagagtctattcttttaagtacttcggaggaaggccaaaatcaagggcagcccctgtggtgaagaatcactaaatgtcttgatggtttggtgaagtgtgcaagagtggagtcacttgtttgtcttggtgattttggtgtgtgtgtgcatatgttctgaagcagtgcttctcaaactttagcatgagtatgtatcattagagaacttgttaaaaatgcagattctgatccaatagctctgaagtaggtctacatttctaacaagttcccaggcgatgataatgctgcccctccacagaccacactttgactggcaatgtggcagggtcatcgcatgccttagtctcagggcttattttggtactaaatgaccaagctcttcccaccctctactccctcaccaagctgccacttctagtcactggtcaggtgtcattgcaggatgatgggaagcctaattcatttattcattcagcaaatatatgccctagaacaggaaattgaggctcccaatttgccaaatcctagaaactggaatcttcagcacacaaaaactactgttacacaaaaaggccttgtgttagatttcctgcatgtctccaccttttctccatggctccaagcttccctaaacttcccttattctctgccttcaacttgagaagtactggagcagaatgtgtggctgcctgcagaatcttgtgctgggtgttggagtcccagggagctagaggtagcagggactcagggctctgagactggcaacagtgtgcctgaggcattgtctacgctctgcagaagaaaggtgggaataattctaggagcaaagcaaggaaagtgggtgcagagagaaccgatggaatttctttaggcttgaaaacttgagggggttgtgaagagaaaataagttgttggagaaaaaaatccagagtagaggttgtctaacatgtatgaaacatgctgtttttgttagatcatcaaagtgactttagagaccgacagtggcagtacatgccctgttacacaaagaggtgtttccttccataaccactgcttggtttaaaaaaatttaaaaagaagcaaaaaaaaaaaaaaaaaagaagtgtttccttttgattcataggaaggatgtaaagcattgctttatgtccgtgaggatacaagtaacatagcacatgcccattaaagaaaacatgatactatagattacagtagggaagaaaaacaatcacttgtaatattttggtgccatttcctggcagttttttttttttttttttactatgcctgggttgtttctctcatttggcattcacttgaataggaccttgaaaagttatgagatggcaccatgatcattaggctatatatgcagttttaaagcctggttttactgtagcagtgaagcacatgtattttccattttatagcgtggtctttgttagcgtaatttttatagtcacatagtttatttaacagttctcctgttattgaatattgaggatgtttccatttccaataaatgtctttgtgcaggaagttttttccatatgtaggattgcactctgaggacaggatcccagaaatagacttactagattgaaacttgttaatgttttttaaagttcttgattactgttgccaggttgcattcccaaaggttgggcccttcatgctctcaaaagcagttcctgttttgtggcatccctgacagctttggtgtttttgtttttaaataattttatcaatttttagattgttttagtttgtatttcttaattacagtaaatttgacatttttcacgatatacttcttttgtatactttttacatccttttcctgtttattataatacttatttggatttgatgtttttaatcaacttatgtgcatgctttatcatataaaagtattcaagttttcctgccatacttataatagtttttctgtatttatttatttatttatttatttttgttatgacggggtttcaccatgttgcccaggctggtctcaaactcctggactcaagtgatctgcctgcctaggcctcccaaaatgctgggattacaggtgtgagccaccacacccggcctctgatagtttttctgaatctgttcttactgtgaatagatccaacacatttttatatgtggtgtcatcgttttctaaatagtttgacatcacatttttattctctgtagcccagaatattacttctaaaagattgtaaatgatttttatttttgtttgccattataattaatttttcattttttccatgatggttagagaatatggctttataatttctgaggtttccttgtaactaagcatatgatgggtttgtgtaaatctatgaacacttgtgaagaagctgtatgtttttaggatataaaattggatatttattaatcaatccagtcttttcaattatatggtaatttatctccaaccataatattctctgatgggtagagaggagcttagtcctaccaacaccttgatttcagtccagtgaaactgatttcagccttcagacttccagaactgtaagagaataaatgtgtcttgttttaaaccactgagtttttttatggtaatttgttatagcaggcaaagaaaacgaatacggtaagtgtttaatgaaaggaagtgctggtggctttagttagttaacacacaggcttatagtggacattggttcgcacactattctaatcaccttacagatgttaattcagttctccaaccatccaaggaggttggtattatttactgttaaataactcaattgttaaagtctctcagttggtaagtgttgaagttgagattcaaatccatagttgttgatcttattatctggagacacaattcacatatcatacgattcaccaacttaaagtcgacaattcagtggttttagtatattcacaggattgtgtaccaccaccacaatcaattttggaacattttatcaccctgaaaagaaacctcatacctattaatgggcactccccatttcctccctacatggcccccaccgttctgagtcctaggaaaacaccaatctactttctgtccccacagttttgccaattctggacattcatttcatagcatatatcccattgaatgtatataccacattttattcatcagttgatgaatatttggattgtttttactttttgacattatgaataatgctgctgtgagcattcatggacaagtgttggtgtggacttgtttttaatttcttttggttatatacctaggagcaaaattgctgggtcacttgtatgtctatgtttaaccatttgatgaactgccagactgttttccaaagtagctggaccatttacatttccaccagcaatatatggtgattccaatttctccacatccttgccaacactttttattccctatcttttattatagccttcctaatgagtgtgaagtagtatctcattgaggttttgatttgtatttccctgatggctgatggttttgaaaatctattcatgtgtttagtgggcatttgtggatcttttttggaaaaatgcctgttcagatcctttgcccatttttttttttttttttttttgaggtggagttttgctcttgttgcccaggctggagtgtgatggcgtgattttggctcactgcaacctccacctcctgagttcaagcagttctcctgcctcagcctccggagtagctgggattacaggcatgtgccaccacacccggctaattttgtatttttagtagagacgggctttcaccatgttggccaggctggtctcgaactcctgacctcaggtgatccacctgcctcggcctcccaaagtgctgggattacaggcgtgagccaccacgcctggcctctttgcccattttttaaatgggtttacctttttatgattgagttgcaatgattccttatatattcccttttcagatatatgatttccaaaaattttctcccattctgtgggttgtcttttcactttcttgatagtgttgtttgcagcacaaaatttaaaagttttaaattttgatgatattcaatctatagtttctttggttcttatggttttgttgtcctatctaagaaactattgcctaatccaaagtcatgaagatatacatctatattttcttcaaagagctacatagttttagcccttgcatttaggtttttaatccactttgagttagtttttgtatatgttatgaggtaggggccaaacttcatgtttttgtgtgtgaatatctagttgttccagcaccatttgttgaaaagattattattttctccagtgaattgttttggcaccctgttgaaaatcaatttcccataagtgtgagcgtttttttctagactctcagttatattccatttctttatatatctagccctatgtcaattccacatttcttgatactacagcttggtagtaagttttgaaatcaggcagtgtgagtcctccaatttcattttattttttaaatattgtttggggtattatgggtcccattaacttccatatgaattttaagatcaggttgtcaacttctgcaaggaagccagctgagattttgataagattgcatcaactgtaaatctatttagagaatattgccatcttaaaaatattaaatcttctaatccatgaacatatgatgtctttctgtgtatgtaggtcttacttaatttccttaagtaatattttgtagttttcagagtgtaacttttgtatttcttttgttaaatttgttcctaagtatgattttctttttgatgctattataaatataattgttttaaaatttcatttttggtttgttatcatagatttactttttttgttgttgtattaatttttttattttaaaatgacttcaaaattacagaaaagttacaagaacaattcaaagagcatttcacaagtattcaccaatttaaaaaattctgccacatttatcattctctcttcccttttatatctctcccacacacaacagtcacatatagtattgttcctgaaccatttgagaataagttgtatatattatgttcctttacccctaaatatttcagtatgtatttcctaagaacaaagattttctcttatataaccacagtacagtagtcaaactcaggaaatctaacactgatagaatactttcaattgtagtccataatcaaattttgttaattggtcaaacaattgttatcatagatttacttttaacctcaattacgctcaatactatattcctcataagttcttagattctctaacagtgcttcaaataataatgacttcatgctcttaatgcaattaagattcatttaattcaatacaattgtctgttgtctatttacctctactcatattttgtatgtttttgcagttcatattttgataaaatattgaaataactctttttatctacttttttagtcctaaattctgttcccccttctcatttggctgatatattttgtccatctttatttttaatctttctaaatccaatttgattctctgttttaataaaggaatgtaaacagttcacatttattttatctgccttttctcattttattctctttagtgtttaatgtttttttctgttatgctttttgctatacagactctggactttgttatttgtttttatatttccacaaagctgtgaataacggacatcttacttttaattgtacttgtagcaatcttttttttttttttgaggcagggtcttgctctgtcacctaggctggagtgcagtagcataatcatagctcaatgtaaccttgaactcctgggctcaggtgatcctcctgcctcagccttctgagtagctagggctacaggcgtgcaccaccatacccagctgattttttattttttgtagaaacagggtcttgttatgttgcccaggctgtggaaataaaagaaaagcattccatcctggctaacatggtgaaaccccatctctactaaaaatacaaaaaaaattagccgggcgtggtggtgggcgcctatagtcccagctactcgggaggctgaggcaggagaatggtgtgaacctgggaggcagagcttcagtgagccgagatcataccactgcactccagcctgggagacagagcgagactccatctcaaaaaaaaaaaaaaaaaaagaaagaaaaaaggaaagcaaaacattcctgagcttaaatttatcttaatatcaaagtgaaattagtaatttttgaccccattatgagagaaggattaagagtttttgtgtccctgtgtcctcctttttcttattttaaatatttaatttgataatattataaattcaaatagtaaaaattatgttagtcacttatttcacaggattttttctctttatttggatattaataatcaaattcatccatccatgaatttaatgaattttaatatagttcttatctcactatgcctttccccattcttgggaccctaatcttgattcctttcataatgatctagtaagcatattaatttttagaaaggggatcagtgttataaaagagagacaacttctcttaaatatagcaatctttccccctcaagtcattggaaatattcctccattgtcttgagaagtttgatgctgtaaagaagttgctatagtttgaatatgtccccccaaaagcatatgttcaaaacttaatccccagtataacaatgttgggaggcaagacctactggaggtgcttgggtcatgagggctccaccctgatgaatggatcaatgccaataataaaaggacttgaagctgtgagtttgttctcttgctcttatgctctcttgccctttgctttctgccatgggatgacacagcaagaaggcccttgccagatgctggccccttgatctggaacttcccagcctccagaactgtgagccaaataaacttctgttgtttataaatgactcagtctgttgtagcagcacaaaacagactcagaagttgaggacaactgttttttagcctgaatggtttttgttccccatttctgaaatttacaactttcacaataagataactgggtatagacttcctttcaaaaatttttgcctgggatatggtaaaccctcttgatttccaaatttaggacttatttaggagcaagaaagatttcttctgtcacaactttgattaatgctgctgttttgtttgtttgtttttttcttcttcagggacctatttggatctcttatctctaaattgcctgcctgtggcctgcctgcctgcctccttccctctttctttctctttccctctctttcttctttctttcttttcttttttctttctttctctctctctttctttctccttccttctttattcctttcattttcttcatttatttttcattgcattctgagactattttcctaagaatttcctctatatcactgattcaattttccttaactatctcccatataaactttcattcagttacagtgtttttggcttccatgaaatcttttattttagcttgtttatggcaacatcctcttgtacagagttcaaaaaaacaaacgatttccatctattcctgcttcatatctattttagaggcaagcttttccttcattgttctttctattttcttgcaaaatttatttaatctaaggccttatccttgaaagaaaagagattccttttgtatgtatgtatggatgaatgtgtttttcaccttatcctaaaaagtatttaaggatgtattaggggagatttatcccagtctaacgttgatatggatggaatgcatagtctgcccatggctcccttaggttctgttcaggtcttggaaaaatgcaatcaccaaatgctagatccccatctaagtatgagaagacatctaaatcctccaggcagaaaagttcactcagacccaggaaagaaggcaaaagtctcgccatgtacagtagtcatgttccagaagatagagtgactagggctgtcagagttctgtcaatatggttgtccagaggcataaaggcattcaggaaggagcctttgctccttccccactgagagcaaacctctgttgaattagggagtgagctcctgttccactgcttagcagttttcctcagcctttttttggatatcatttctaagatctctttagacttgtggtagcatatggctgctagtgtggctgtttctgtgaagaacattccacgcagaggaaccaacatgtacaaagtcctgaggagaaattaagtgtttaagaaacaacaaagaatccagtgtggttggagtggagaaagcaaggaggtgagagctgagaggtaggtttggcctaaatagaatgtctagcatcctgcaggccactgtatagcctttggcttttacttatagagcaatgggaaaccactgtgagtgttgagcacaggagtgactttatccaattcacgttttaataggatcactctggctgcattgtagagaacagacataaagggatataagcagagagactagtcgggagactactgcagtaatacaggtaaaagatgatggtgtccatttccaggtagtagcagtggacacggtgaaaagtgattggatttgggatctaatagagccaataaaatctcctagttggatttagatgggaaacaagagaggaggaaacttgactccaaggttttgggccttccaagaaactagaaggatggagttgccttgagatgagaagactgtaggaggaatagttttgagtgggaagatcaggatctcggttttgggtgtgttaatgttccgatgcctatttgacatgggtctttcaaatagagcagatggatatacaaatttggagtttggggaagaagactggacttgagatacaaatttaggtcatcagatggtgtttaaactgagtgagacaggatttaaatccaatgagactgggtaagtgagtgtaactagaaaaaaaaaaaaacgacaatgctctaaggactgagccggatgctccaactttaaaggttggggataggaagagaaaccgtccaagaagattgagagagagagagagagtgagtgagtgagtgtgtgtgtgtgtgtgtgtgtgtgtgttggagtgggggaaggaggataaactaggtaggtgagtatggtgtcctgggagccatcggagaaaagtgtttcaactgggtctaactgggtctaatgctgctcatgggtaaaataagatgaaactgagaattgaccctggcatttggcacagtgaatgttgaaagttgttagtaaagatttcacaggtagaggaagtcttttagggatggaaatatttacagagaggtgtgtaacttcctggtgctgatgtccatccagactgcagacattttctgtgaaagaaaagccagaggcctttcagggccaggaagtatggtctttttcaattgtgtttttctcaaaaagcttgctctaagattcacattgtgaagacagcccaaactccaggcccctacctactgttactcttcccagaactgccttatggcttcagagagcagatctgtttgcaaaactaatggaggattagggctggggaggagtagaagatcacatttcaaatgtggtgtaggtatctatgcatttggcattttaaaaagactcagtggattttagtgctagaagagacttaaatatcctcaaatctcttaattaaaatgaaatcaattgcatttgctgttttaattacaaaaataatacaagtttataacaaaatttaaaatatataaagaataaataagaaaataaaaatttgtgtaagtttactactcataactctgtcatatgactttttagtctttctcttgttccctctctttggcttactttttattgttttttagtatttattttctacaaatttggatccatgttatgcataccaattgtaatcctcaattttactttacagtttgtcgtgacaattgaatggcttttaccatatgatcttttaatggctgcatataatattccatcatttgaacatgtaccatatgtctatttaaccatttccttttgggaaacatttgagaaacttccagttactttccaaattatttttcaaaaacatttgcaagttattttccaaatatataattatattataacttctgtggattaatctcatttcacatctttgacagtttctttaggatcaattcctaaaagtagaatttccaaatttctttccaaatttcagcagtgtatgagtgatagaaacattgaagtcctgaggtgggaaggaatgtgctcatgttgcacaactggttggtggctgagtgtgcccagttcccttgcctttttgaaagagcccctctccttttcttcctaccatgctttctatagcatttcagcctccttttagtgatgtcccgtatgactccttggaccttgatgacatttaaccttttcctgaaaactcttggctcccacttatcccaaactagtcccccagtgtatctctgggcatgaactctgaacaattagagatgtcctttttcatgagagaagatgtacacttctcagatacattttctctttaggggtacaaatgttttcccattagtcaagaactgccacccattagatattccttcatgtatccgaaggcttcctggagttttcctgacttctttttagctttactgatcatatattttctctctaaaatcttactcactgtagtacagacatactttaaagttattgcaagttttgttccagaccgctacaaaggaagtaacgtgattaaaagagtagtatgaatttttggtttcccagtgcatataaaagttatgtttacactatactgtatctattaagtgtacaatagcattatgtttaaaaaaatgcaccttaattaaaaatactttattgctaaaaaaatgctaacagtcatctgaaccttcagtgagtggtactctttttgttggtggagagtcttgccttgatgtttatgttgctgacttatcaggagttggttgctgaaggttggagtggctgtggcaatttattaaaagaagacaacaatgatgtttaccacattgaatgactcttcctttcgtgacagatttctctgtagcatgtggtgctgtttgataacattttactaacagtagaacttctttcaaaattggagtcaatcctcctccagcactcctgctgtttcattgagcaagtttacataatattctaaatcctttgctgtcatttcaacaatgttcacagtatcttccccaagagtagattccatctcaagaaaccactttctctgttcatccataagaagcaactccacagctgttcaagtttcatcatgagattgcagccattcattcacatcttcaggctccactactaattctagttctcctgctgtttccatcacttctgtagtcactttctccactgaagtcttgagcccctccaagtcattcatgagggttggagtcaacttcttccaaactcctgttaatattggtattttgacctcctcccatgaatcatgaatgttcttaatggcacctagaatggtaatttttgtccagaaggctttcaatttactttgcccaggtccaacagaaaaatcattatgtatgatagctatagccttattaaatgtatttcttaaatgagacttgaaagtcaaaattactttgttttgtgttgctataaaggaataccagagacagggaaatttataaagaaagaaagtttatttggctcacaattctgatggcttgaaagctcaagattgggcatctggcgagggtttcaggctgcttccactcttggaggaaggtgaaggggagccagagtgtgcagagatcacatggtgggagaggaagcaaagtatagagaggccggtgctagcctctttttaacaaccgctctcatgggaacgaatagagtaagagttcactcacccccaaagaaggtcattgatctatgcatgagggatctgcccccatgaccaaacacctcccatttggccccacctctaacactggggataaaatttcagtatgaggcttggaggagacaaatatccaaaccgtagcactccttgatccatagactgcagaatggatgttgtattagcaggcatgaaaacatttatcttcttgtatatcttcatcagagctcttggatgactaggtgcattgtcaatggacagtaatattttggaaggaattttttttttctgagaagcagacatcaacagtgggcttaaaatattcagtaaaccttactgtaaacagatttatggtcatccagccttttttgttccatttatagagcacaggcagagcagatttaacataattcttaaaggccctaggattttcagaatggtcaattaataatggcttaaacttaaagtcactagcttcattatcctttaacaagagagtcatcctgtcctttgaagctttgaagccatccttttttatggctgcatagtattccgtggtgtatatgtgccacattttcttaatccggtctatcactgatgaacatttgggttggttccaagtctttgctattgtgaatagtgctgcaataaacatacatgtgcatgtgtctttacagtagcatgatttataatcctttgggtagatacccagtaatgggattgctgggtcaaatggtatttctagttctaggtccttgaggagttgccacactgtcttccacaatggttgaactagtttacactcccaccaacagtgtaaaagcgttcctatttctccacatcctctccagcgtctgttgtttcctgactttttaatgattgccattctaactggtgtgagatggtatctcattgtggttttgatttgcatttctctgatgaccagtgatgatgagcattttttaatgtgtctgttggctgcatagatgtcttcttttgagaagtgtctgttcatatcctttgcccacttttcgatggagttgtttttttcttgtaaatttgtttaagttctttgtagattctggatattagccctttgtcaaataggtagattgcaaaaattttctcccattctgtaggttgtctgttcactctgatggtagtttctttagctgtgcagaagctctttagtttaattagatcccatttgtctattttggcttttgttgccattgcttttggtgttttagtcatgaagtctttgcccatacctatgtcctgaatggcattgcctaggttttcttctagggttttcctggttttaggtctaacatttaagtctttaatccttcttgaattaatttttgtataaggtgtaaggaagggatccagtttcagctttctacatatgcctagccagttttcccaggaccatttattaaatagggaatcatttccccatttcttgtttttatcaggtttgtcaaagatcagatggttgtagatgtgtggtgttatttctgaggcctctgttgtgttccactggtctatctctctgttttggtaccagtaccatgctgttttggttactgtagccttgtagtatagtttgaagtcaggtagtgtgatgcttccagctttgttctttttgcttaggattgtcttggcaatgtgggctcttttttggttccataggaactttaaagtagttttttccaattctgtgaagaaagtcattggtagcttgatggagatggcattgaatctacaaattaccttgggcagtatggccattttcatgatattgattcttcctatccatgagcatggaatgttcttccatttgtttgtgtccttttttatttcgttgagcagtggtttgtagttctcctttaaggggtcctttacatcccttgtgagttggattcctaggtattttattctctttgaagcaattctgaatgggagttcactcatcatttggctttctgtttgttattggtgtataagaatgcttgtgattttcgcatattaattttgtatcctgagactttgctgaagttgcttatcagcttaaggagattttgggctgagacaatggggttttctaaatatacaatcaggtcatctgcaaacagggacaatttgacttcctcttttcctaattgaataccctttatttctttctcttgcctgattgccctggccagaacttccaacactatgttgaataggagtggtgagagagagggcatctctgtcttgtgccagttttcaaagggaatgcttccagtttttgcccattcagtatgatattggctgtgggtttgtcataaatagctcttattattttgagatatgttccatcaatacctagtttattgagaatttttagcatgaagggctgttgaattttgtcaaagaccttttctgcctctattgagataatcatgtggtttttgtctttggtatattctgttgatttgggtggagagttctgtagatgtctattaggtttgcttggtgcagagctgagttcaagtactggatatccttgttaaccttctgtctcattgatctgtctaatattgacagtggggtgttaaaatctcccattattattgtgtgggagtctaagtctctttgtaggtctctaaggactcgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctacttttttttgctttccatttgcttgttagatcttcctccatccatttattttgagcctatgtgcgttccttgcacatgagatgggtctcctgaatacagcagactgatgggtcttgactatatccaatttgccagtctgtgtcttttaattggagcatttagcccatttacatttaaggttcatattgttatgtgtgaatttgatcctgtcattatgatgttagctggttattttacccattagtttatgcagtttcttcctagcatcgacagtctttacgatttggcatgtttttgcagtggttgctaccggttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattatgggttgaaaattcttttctttaagaatgttgaatattggcccccactctcttctggcttgtagagtttctgccgagagatccactgtgagtctgatgggcttccctttgtgggtaacccgacctttctctctggttgcccttaacattttttccttcaccttggtgaatctgacaattatgtgtcttggggttgctcttctcaaggagtatctttatggtgttctctgtgtttccggaatttgaatattggcctgccttgctaggttgaggaagttctcgtggataacatcctgaagagtgttttccaacttggtcctattctccccatcacttttaggtacaccaatcaaatgtagatttggtcttttcacatagtcccatatttcttggaggctttgttcatttctttttactcttttttctctaaatttctcttctcacttcatttcattcatttgatcttccatcactgataccctttcttccatttgatcgaattggctaatgaagcttgtgcatgggtcacatagttctcatgccatggttttcagcttggtcatttaaggtgttctctacactgtttattctagttagccatttatctaatcgtttttcaaggtttttagcttccttgcgatgggttcgaacatcctcctttagcttggaggaatttgtcattaccaaccttctgaagcctacttctgtcagctcgtcaaagtcattctccatccagctttgtttctttgctggcgaggagctgtgatcctttggaggaaaagaggccctctggtttttagaattttctgcttttctgctctggtttctccccatctttgtggttttaatctacctttggtctttgatgttggtgacctacagatggggttttagtgtggatgtcctttttgttgatgttgatgctattcctttctgtttgttagttttccttctaacagtcaggtcccttaactgcaggtctgttggagtttgctggaggtccactccagaccctgtttttctgggtatcaccagcagaggctgcagaacagcaaatattgcagaacagcaaatattgctgcctgatccttcctctggaagcttcgtcctagaggggtgcccgcctgtatgaagagtcagctggcccctactgggaggtgtctcccagttaggctacatgggggtcagagacccacttgagtaggcagtctgtctgttctctgagctcaaacaccatgctgggagaaccactgctctcttcagagctgttagacagggacgtttacatctgcagaagttgtctgctgccttttgttcagctatgccctgcccccagaggtggagactacagaggcagtaggccttgctgagctgcggtgggctctgcccagttcgatcttccaggacactttgtttacctactcaaacctcggcaatggcggatgcccctccgcctgcctcgcaggttgatctcagactgctgcactagaagtgagcaaggctttgtgggcatgggatccgctgaaccatgtgtgggatataatctcctggtgtgccatttgctgaaactgttggaaaagcacagtattagggcaggagtgtcctgtttttccaggtaccatctgtcatggcttcccttggctaggaaagggaaatcccctgatcccttgcgctttccaggtgaggtgatgtcccgccctgcttcagctcgtcctccatgggctgcacccactgtccaaccagtcccaatgagatgaaccaggtacctcagttggaaatgcaaaaatcacctgtcttctttgtcagtcatgctgggagctgcagactggagctgttcccattcagccatcttggaaccaagatgtttctaatgacagacagggaaaagaaaactgacaagacccaggcagttgacttgactcttgttagagctcaacaggtggtttgtagttgaggaagtgtcaatggctaaaagatatgagaaaatatccaacttcactggtaggcaaacaaagtaaactaaaacagtgaggtactatttttcacatacctaaaagatttttttcttaatatccagtgttgttgaaaatgtggggaaactaatattccctaactgttggctagaatgcaatggataaaatttgacattttgctctactttttaggatatgtcctcaaccttatcttttaacctttttgttaaaatttcttattttggttattactgtttaaatttctaaaatcttgtttttattttctgatagtttatttaaataaaattgtacacttttttggtatcatggatgcaatattttctcctctctctgatgatagtaattaatgttttcttctttgtttcctctgtttttttaactgtgtttttaacttttcatttatgtctttcatgttgaagaccttttcacatattatcttacttaatcttcactcagttctatcaggttaatattattatccttgttttatagttaatgagtcttagagagtgtatcattgttttatttctcttaccatgggcagctgaaaaaattgttggtcatagaccaaaagtactggtcacagaccagccaaatccacagtccagcttcttaatctagctggattctctgttgaatccttaaaatctctcctcaccacctccctaaccccaacacttgtctcattatattagacaactttgttagaattttttccaagttgaattaaagtctttctccttccctttacctttccactgtcattagaactagttctgccctgtagaccatagagatcctctcccatttctacatctccttccataggagatagtccctcaaatatttgaaatgatactgtcatgattcctccacatctgccattccccagcctgaagaggcctggttctgcctactttattctgcacctttgtgaaattctgcttggctaacatttttggaacgctttggaccatgttctctcaaagtctcactttaagggtgtgtctataacttaacatagggtccagatatgctctgaaagacttaacctcaaatgggatactgtcattttattaatgtatgctggagttggcttagtttcaatttgaggaatttcatgtgctgcaacttcttttcctagaaagtaatacttttgatgtttctcacaaattataatttctaggactctgagctgcctacttctacttactcctttttagttagggttgtgtgtgtgtgttgtccttactggttactgcttttacctcctagggtctttttttcaaggccattttcacttaaccttagctattaagcccaagtggaggtgctaaggtgatttgaaaaatggaaatatcttaatttaaattgcacaaacaaacactatcgtgcatatttgagaagtaaaatacaatgtaaatgggggcttttcaggcaccatgttaagcacttggtatatattatttcatttggcttttataacagcattatgaggtgagaactgctgttattctcaatttagatgtgaggaggtgtggctagttcgatacaactaggagggccagaggtgtattgcagacctaaacataccagactcaagactaatactgctgttacccacagaaatgaagctcacatattgtattttatgccaattatagctgatgttgttggaaggaattatataatctgctgaggtgtattgcatacttctcatctttaacagaacataccaaacataaaaacttttatttgataggttgaggtgatgatattgaacatctgtcctcccatgttcattgtagcactattcacaatagctaagatttggaagcaacctaagtgtccgtcaaacattaatttttgtggccctttaagtaagaataaatatgtggccctataaatatgaatcttatgtatatttgtatagacagtgccaagcatattgtaggcaactatgattcaaatcactgcacacatgcgtattgaatgagtacatgaatgaatcaatgaagttataaaacagcaatgacctcaaggtctattaaagtttttagaactatttgccactacactaaatcttttataaactgttttgctttatgagtctatgtgtctgctttttgtaatttttttcccttctccctgtcattgtaaatagaatatctatggacatgaaatgtgcctgaagttctttgcaaatggaagactaaaaggaagttgccccaggcaattcagatcattgtgtccaagagaggaacaaactcatgtttgatccaggtcatgactgtattcaagggctttgatcctaggtgtggggtccagctgtaggggcatcagggaagtacattcttggtctgtgtccaagtccttggtcagggaagtctgtcttagcaccatggagacaggggaaactgaattcagaccttatgtgacaggagtggactaaaaccagtgcatgcatatgatccagcaattccatggctaggtatacacccaaaagaaagaaaatctgtatatagaagagatatctgccctcccatgttcgttgcagcattattcacaatagctaagatttggaagcaacctaagtgtccatcgacagatgaatggataaaatgtggtacatatacacaatggactgctattcagccataaacataataaaatcctgttatttgcaataacatggatagaactggaagtcattatgttaagtgaaataagtcaggcacagaaagacaaacttcacttgttctcactgatttgtgggagctaaaaattaaaataattgaactgagagagagtagaaggatggttactagaggctgggaagggtagtgggggctgggtagaatggaaaaagggatgggtagtgagtacaaaaaatagttagaaagaatgaataagacctagtatttgatagcgcaacagggtgctatcaaacctattgccttggtttgcaatagggtgactatagacaataataatttaattgaacatttaaaaataactaaaagagtataattggattgtaacacaaaagataaatgcttgaggtgatggatacctcatttatcctgatgtgattattacgcattgcatgcctgtaacaaaatatctcaagtaccccataaatatagatacctactgtgtacccataaaaattaaaaataaaaaaataaaaataaaatcagcatagggagccagtctcctactaatttggtcaacagtttatgtcaggttgtagtcttaagggtggaaacgaaaagagggccaggaccttggtagccagaccaaagttcacgactgtgttatatactctgaaatggatttagccaaggaggtttgcccagattctcccataggtgatgttaaattccttccaggacacttgaccccaggcatgggattgatggtgggttttcaggtgctctcccactaaagcaaaaatgtccataatatattccaggaattaggtgagacagagcctcaggaaacaagcctgttatgccttcaccaaggcagggcagagctggataagggtgaacagaaagggacaaattattgatgagagttctgtgagtagaaactcctttctcttctttagaatttctgcctccagtttgttaatgccacttccaaaatacactgctctgagctgaagataatactgcatgcagatagagtgccatgaaggcattggtttgcagtgatctataaaggactaatgtgccaggctctgtgttaagtgcttgactttcaccaccttgtttacccctacaacaacaatttttaaattgccctattaagatatagagcattctatcattctaaaatgtttcctgtgattcagtatatatttatttactttttggttgatttattgagtgaagaactgaaaatcactttatgggtagtatatttccttttttgtatcacatctgaagtgagacattgtcaaactgggtaggtatgtccagaatgaggaaggatgcagagactatgtcatataaggaacatgtgtcaaaggaggtagtaaaaatgaatatgactggggctagtagttccaagaaaaaattggaaacatgctcctggctaatcagaaggtttagctaaaatattttcagagcctatcacgtgaacctggtaaaaacaacccagtattgggcaaaagagttagggcaatttgaggaagtcctggcgcctaggctaggtggtgatgaacagggaagatgtgaaggaaaaaggaagagagaattttcccccttgccttattgatttcatcctgcattagttcatctcagctcttcctgttgttcccccaaccccaacagtttttctattcttttatctatttttgaattgattctctaaaagttctaaggctgcgttttcagctcctggtcatctggataactactggtttcaggattcttggggataatgggatggaggcatgggaggagaatgtctgggttaaaaagatactgagctagaagtagaaggcttggttgaattttacactcagcaacatacaggttgggcaagttgctttgctctttagcttcagcttttgcacacctataaaatggaagcggtgtgtgtgtgtgtttgtgtgtgtgtgtgtagtgtatgtatccgttgtctcctagggagtttctttgaggatcaaaaaagagagtggacaaaaatgaattttgtaaactgtttttgagagcatctaaatgtagttttatgagtagcattgttaccattgtcgctgttctatttgctgaatcttgtttaatttggaagctccctaattcacagtgatttgtatagtggggtcatcactctgtaggagctctaaatggagactttgtccatgatttccaaaaggtcatccaccccagagtcacatgagactggaaagcaaatctttttcattaattggcttcaagtactttcagcttcaaatggaggtctctaagggtccttggctggcacatcaagggggcatttcaaagaaagtggcaaaatcttgactaaacttcagagcaaacacgcactcttttctttgctactctctttctaaaaagaaaaacaaattatactggtctgggttgtgtgagcatgtgtgtatcagcttgttctaattctcttttcccaaccccttctttgcttgtcccattttcaagataggataacacccaggtttttatattaccttctgtgttaggactttcttaggattcctaaaaattttggctaagtagcattaggcctgctctatttcacaggtaggcataaaaaaaaaaaaaacagtgtccacttcttcaagacagtatccaattcttcctggcattttgatggtaggaaaaatatttgaatttatttttagggcaagtcacgtggcaaaaagaataacaagtatttatggttgcctggggaactcagcttctagttactactgattatgggaaagaggaacaaattttaagatgaggcaaaattggtgaccaagaactagaatagcaggtggcctgggaagaggtgggggtgaaagcgggtagaaaatctatgcaaaaatataggttcctagtcattttttttcttttgtctctttcgattactatatcctgccttcctgcaggaggaatgtagtaagatgctttgtataatcaggtgctttgcttgttcttttttttttttttttgattgtagaaaagatcagtgtagcaatttgaccatttgccaaattacccataagatagggtaggcattaaaaacccagggacactgaagtcaggaaatccagcttcttgtatcctggatctttcttggaacagcctgtcacatatgacatctaatgatgtagcaccagctgctcacaaatacaagttccttagagtatatagacattatggggccactaaaaatgtcttatatggcttgctgccagcattttcagcactgtctctcaccagcagccactctctaactgtttgccctagccaagctcagagacatggggactcctatgagctccattgtcttgtgtagagaatggggctaactgtagagtgtgaaggcctggggagaaaaactcaggctgtgtttcctagtcaccccaagaccttgtggacccaggaagtagcagttccagagaccaattgctatatggctttctgcatgcccactgcctttgtcttgctgttgtcgcaggaaacatctggtgtacatccagtgcacccagagccttttggaaaacacctatcggcctcagtactcttttccctcaggctggcagacaatgaggaaggaggagagagagctacccattggaggaggaagtaaagctggaggctggggtagtggcaagatatgagcattcaggtctacaaagcttcaagtctctcattacttcactccatcaggccaggacaatcatgggggtttggcaggagtggcgttgcagggagtttaggcctaagggagtgtatgtgtgaggcacaaagtaataaggactggactttgttacctgaggtgatgagggtgacaggcccacatggataaattaggaaacaggcaacaggttctatagctgcatatcagagactcacagagtggaaatcactttgatgagggcagagcagcagcccaaatgaccggatacccactgtggaagtcatcccctcatcactttttcattcccaagactcagctcttctctgactctgttactttgttggcaactcccgttgcagtgtctgggcaatttctctcagttgttacaacttgcattcaagggcatctcttgttccaggccaactctattgatctctgaaaaaatgggaggtagaacagtgttcaagcattcagataaacctaccttccaatcatagttctgcttcttactagctgtcccaccttaggcaggtaagttaacttatctgaatgtcagttttcccgcttgtaaaatgcagttggtattagtacttaatttaaagctttgttatgaggattaaatgagataatgcaagtccagcctatagttgactttggcttaagcagcagttgttggaacaatctgttgtggccaagatcataaggtctcaggacacaaggttggccacaaaaccaacccagcaacttatgaagcagaaaccatctgtggtaacttttctcagaaggtggctatgtaaactggcctcatttggctgaaggaagttgggaggtggataggtgggggaaataaaagaaaagagaagagttaaatgagtgtcaatgtctcctaataattaagagcttagaatccctggagtcagacaggcttgtcctcaaattccagctctgtgcttaccatttgtgtgaccacgaatatgttatcaaacttttggaccccagttttctcaagtgcaaaataggctaatgatatctatggtgttgtgataatttgatgaacaatgagtataaagtgcttagcacagtgcctgctacccagtaagaacataacaaatggggaagaggatgattgtgaggatggcaagcgtttttcttggcctagcatccagtggtgctgctcttgttatctaaggaggcaggaaggagacaagagtgggcacttggtaaaactggatgcaggtgaaagagaggtgtttatctgagggcctcatatctgagcctcacttctacctcctgaccccttatgtcctcccaccctgctacccagtgcttgggtgctgcttaaagcactttgttccaaactccctagggatggtttgcccctccccttcccataatgactcaaaacttctgttcattctgttcagctttgccacagccaggttttggtgagaaggaccacacagcttcctttgactttaaggccaccagaggtatttctttttaactccaccaaattggaaattagtggagcaataagcaatggaggatggagggtactttgagcacagagacttccatattgccctgaaaaggagcctgaaagacaaggttgaaggagacgcaggttcagtaggggagggagaaggaatgcatatccctagcttccgtattgcactaccgtcctttgcctgagaaagcgaaccctggtgttagaatctgagactaatgttgttccccaaggaggaaggcagctcaggactggttcccaccaagccaagtgcagtcctagattctggctccctgtgcccactgtcagcagagaaagcaccaaatctagtgagaaaaagtttcagcatatcttaaaatgacagaaaccaccttatccaacctagacttttctgccatgggaaaaagatgaaacctggaaatctgggaaacttaaaattttcaacaccatttataaatataaaaagcctctggttacttgagtgttgcacatttagatatttgattttgtatgttgattacaaatggagttgtggccttgcaaaccatcacaatcatcattataatcattgaatttatggttcatatggcagtttcttatacattattcaatttactttaatcctcttaactctgtcaagtaggtattaccattaatcctcattttacagctgaggaaacaaggtagaaaaggtgacttactcaagatcccagagctagtaacctcgaggttttgttttgctctttggttttgttttcaatttaggtaatgagctaccaacattagaatgatgcatagaaaggtgctgggccatggtctttgcatcttccaataaagcataataagatatattaatttccaggaaaagagttgagggagaaaaaagggggaatatgatttattgatacaacttttagggaaatttgatcagcgtagtattccaagctttattttgatcattttcaaaccaaagtttaatctgttaaaatagacatgcttcttttactctgtgtaaacatgaagctccacatattacaagagggcttggaaggatgggcctactaattggtacagagcaacaaagtctattttttatttaaagatataggtgttttaggaaggagaggggatgttaaagatagtatttggctgtatgaaaatatagaagtatgagactggcagctctgtagagggctttgggtgagagaatacaaaggagagaaaatgagaaagacattgttgtatgaatataagataaaccaccccagttaagtgcaggctctggatgaagtatttctattacaaatgacagagctgggacagaagcaatgtagactgttgatgcagtatctcgaggggagtttgcacactggatatgtaaattattattgtttaaagatattcttccatcttggggaagttgcttaacctatattatttgcatttttcttatttgcaaaatgggactaaaacagtacagttcttaccatatgtaatctttgagagtattaacaaaaaaaagtatgtgaagtgcctactacagtgcttgtcataaagaaggctgcagtggatatggcaacactttcctccatcaacccccacccccaaattcctttcagttatgaaaattctgaaacactgtaactttacctatatatttattggatatctacttttcgaaaagtagaacatgtgaagaattcttgatttttccttggagatacctttgcaagttagaggaagatattagtgcctgtcttccttggtttaattttaattcaaaagaaagatatgattgagaaggtaggagaaatgactgactagttcatctaggcattaatagtcctaaaagagggaactgtaaggcaaccagacacatggcctcaattttttaagaaggcagatttaaaaataaatacatgcataaataaaattttaaaacaaaaccagaaaaaatggtagacgaattctcatgatcaaatttactaaaaagaatatggctttaaaagatgagtctaggccaggcatagtggctcacgcctgtaatcccagcactttgggaggctgagttggggaatcatttgaggtcaggagttcgagaccagcctggccaacatggtgaaaccccatctctactaaaaatacaaacattagctgggcgtggtggtgggtgcctgtaatcccagatacgttggaggctgaggcaggagaatcacttgaacatgggaggtggaggttgcagtgagctgagattgcaccactgcactgcagcctgggcgacaaagtgagactctgtccaaaaaaaaagaaaaaaaagaaaaaagcgagtctaaaaaagaaataactaaatgagaaacctgattatacaataataaataatcataatggatgagaaaagcgaaaagcagttaaaacacttatttgatctgaggaactttacgaggaggcgagaaagtatgggtgagtttaattttcttatatattattttctctattttctaaaaatctctatggtaactatggcttttataaaataaacagttttcccccgaggatttgtacaatagagaaatggatgcaagtaattgagaagaatggttagaagctaggagaattcttttaaaagtagcatcacttggactaaatatctgttggcgatgaggcatggaggaaaaaatgctaaagataacaaaagttattttggttacagttcagtggaagaacatgaacaggaagaggaatgcatagtgatcatggatgatgcaaaggaattggaacctctgaacttctattttgcttccatctagaaaaatggagttcaatcagtacaaagtaaaacatacacaattaagaagtaattgaaatggatgagaatttattgagagcccttgacttttctaaatgagtttaaagaattttagagagatatgctctttaaattattggaattggtaatctaaatagtaaaagatgaaagagaatggatccaggaaactcagtatgagttgatacgtggcaaagtcttaaatatggaagatttgttaacacctaaaaaagaaagctccagtcacttgaaactggcatgcatttattgaatcaacttatatcaaattactcttatttgtaaaatatttagaagggctctagggttaaaaaattttggcagtctctcaaattcatagaaacagtgtacatttgacccttgcacaacacaggtttgaattatatgggtccactttgcaacaattggaaaaactcaaagatgaaccatatagcctagaaatactgaaaaaaattaggtaaaaggtatgtcatgaatgcataaaatatatgtagatattaatctatcattactaccatgaaatatacacaaatctattataaaaagttaacatttatcaaagcttacacaattacagaccatgcatgacaccacttacagttgatagaaatttaaacaaatataaagatgcagtattaagtcataactgcataaaattaactgcattacatactatactactgtaataattttgtagccacctcctcttgctattacagtgagctcaggtgttgcatgtatctgcctagaatgccataaattgcatattgcagtaaaaagtgatctctaatggttctcaagtattttgagtatttttcattgtgtttagtacaacactgtaaactttgaataacaacatgggacccattcaaagtaccacgagtgatattggaagtgctctcaagaagcagagaaaagtcatgactcatgacattacaagaaaaagttgaattgcttcatatgaactgtaggttgatgtctgcagcggtggttgcccaccacttcagatagatgattcatctcatagatggggatcttgcaaacttaccatatcgataaatacagtacagggttataaatgtattttcacttctttttgattttcttaataacattttcttttatgtagcttactttattgtaagaatacaccatataatacatgtaaaatagaaaatatgtgtaaattgactatgtgtgttattggtcaacagactattagttaagtttttggggagtcaaaagttacatgcagattttcaactccgtggaggtcagtacccccaacttccatgttgttcaagggctaactgaagtttatttcatcaagagtttaaaatgttttttagttgtagaaaatttcaaacaaatacaagatgaagagagtaatataataaaccactgtatacttattacccatcattacaaactatcaatattctgagttttttttgtttcatctatcactttcctcccaaccatacctttttgctgtttttggaatattttaagcaaatctcaaatattatatcattttacttgtaagtacttcagtatgaaaaaaatgtatagcagagtctttcatgatatgcccaaagatgagttggagaaatagagattggataagaatgaactaaaaggattggtactaacataaaccatggccaaatcatgttgataaatagtttgaaatctaccttgaagaaaggtggtagggaaatatactacaagattctgtccttgttgttgtcttatgtggcacgatttatcaatgatatggccaaaaatttagaaagcatgcttagcagatttgctaacaatacgtagcttttagtgagactgcaatgtattacataaaaggatcaagtatcatcaggctggaaaaatgagctgaaaccataggttgacatttaattgatacacacaaggtgagattcctgacttggaggtagttcatgggaagatctgtaggttttactagacccgtagccctcagtatgagtatctaaaatgatgagtcatatttaaacagtgttaatgtttagtttccaggtgaagggctataataacttcactgtatctgctatattcagttcagagcaatgtattttgagaaggacattacaaactgaagggcatctagtggagggtaattagggtgacataaaatctgaaaatcgtgatatgtaaagaatggtaaatggaactggagctatttagcctggagaataggggacttgaggatggggtttatatactggcaacccatgaggacttgaaaaacaaatttttaatgaagtaaacaaattctaatttgctttgtagcttcgagctgggatcagagagtggaagttagaatgaaacagaacttaggtcaagatagattgctaacagttagacatgtctggcaatggcttagactacctggatatgcacttctgtcccatcagtggagaattttactgcagagggtaaatacccatcttttaaacaggattaccacttggaaggagttggactaagttagaggttcacaagggagaactttggctgtacattagaatcacccggctgggggtagaggtgttaaaagtgaacagtgcctgggccccatgctagaaattctgatgtaattgtcccaggtgagactacagaaagtccccagggaactctggagtgtgtgaactctaaggatcctttcaactttgagatttttttttggtttgaaaaagagaaatcatgttcatggggggtattttagaagtcagcatggtggaaaacctgaagatgacagtgaagtcaggcacaaaactgaactcaggggagtaaagagaattgcttaagagagactaaaagtgccagagtttaccaggagacagagaagcttagaggagagggtgccttgcatagttaaaaaaaaacatcaaaagaagtgagagtgggaatggtattaggagaagagagcgtggctgaagaagatgggagtgtccatcagacaacccaccctgctttgcctgggactgagaggtttcttgggatacagcactttcagtgttaaaaccaggacaatcccaggcaaactgggatggttggtcacccgagtgccccataagaccctgtcaaaagacaaaattacaacaaatttagtttaaagatctcaataggctttattgcaattttagaattaggcaacacttcattccataaaacagagtaagtgttccaatgagttgaccagaggcagcaggctttctagacagagaaagggctgaagaaagcagaaacaaagaacaaaaagtagattggacatttcaaagttactttcattgtgggcatagggagatagaaagatggaaagataactgattggttaacatcgggttactctgttgtaagaattaaaacagagggaactgcatgattgccagttgaagactgaaactggcctgttgggaaattaggctgttgcctctctctcctgatttcatggaagaccagataacaaactcaaggtttggagaagcagaaccttagataagggactctattttggtttttaggctggtctgttggggcctagtgcaggggtttagtccaaaacagtggcctcctataatttttgttgaacacccataaatgaaggcagcacgggaaagcatttgttatcctagtcactcttcctgcagagtaaagatgtgctctgcattcatctgaattcatggctttggtgtgcgtaactgcaaaagctgaaatgtcatgttcactctggccacgtattccactcatagtaccatacttgtgtgtccagcatcttgccagggtgctggtcttgggcttactatgctttctttggggtgccttgggattccttacgtcattgcttcctcccaacaccagctgaaacctcctgaagtgattttgaagcttgtttctttgaatagcttcttagcaatttcctcactgctatttcagttcccctcccaccattgtgtgaaacagtgccaaagaatttcattaaactggctgacttcaaggatggtgaactaggactgcttctaaaaagcaggctgatagtaactgagggaattgcctaataaggaatagacgggaggcatgctgcccctacataatctcttccttataaagagagaagtatggatgggatatgttgagttgtttataaaaaataatgaagggaaaatccccctaaaattatggggaaaaggcccctggttgggctttaagtatagagaataacttgggtagtcttcacccactgtatccctaaaaggcctcacaattgctcttcagtctctttctccccttctcatccgccattaattaggaggttacttatgtgtgttatgaattaaagcagtggttctcaaagtgtagtccctggacctgcagcagagcatcacctagcaacttgttagaaatgcatatgccctggcctcacctcagacttactgaatcagaaactctgaggatggggtcaagcagttgtaataagccttccaggtgattctgatgcaggtttatggttaagaattggattagagaaactatgtttttagaaggttctttaaaggagaagtccagggcctaccctctgacatggggctgaacaggaaagcagcaagcagaagaaaccagaactaaccactgagccacggtgggtggtggtttgacatttatgtgacaagacagttaatgtgacaggaaagaaaaatgaacagagaattgtgaaatcaaataggatcagaatgatgtcacagtggtcaatccaattaattcatatcattacaaaattagaaagtcactaatgactaatttctaatatatatctgcataaaagggcattgtatgatatgaattggatttttaagtatacagtattttgtttcattttggagacatagcttttagtaaaaacatgtccaataggttctagtcaatccttaattgaagctctatgttgacaggaaaatagaaactcattgaattttaaaaagatgatttggctactacagttttattattattattttttagagttctgtagcaaagaatcacagaggccaaaaatgtgaaaaaaaaagtcatatggcttaatgatctttgtaatcataaccctatcaaccataacaaaaacaacaatcataagtacagttgccatttatcgagtgcctactctgtgcagacactgctgagtgctcagcacgggggatgaagtcatggataagcagcagacatggtccttgccctcctacccagtgattcccaaccctggctgcacttggcaccagggagccattaaaaaatgtcagtgccaggaccccagcccccgagggattctgatttaattgctttgagatgggaccccagagttggcatttttacaaaggtctccagtgaacctaatgtatatatccggaattgaggactgctctggtgaaagacttacatatgtaaacaattcattataatagccttaagtgctatgaagaaaaagctcagagtgttgtgaagggtaccagttagtgtggggttcagggtagggttttctgaggcatccttgaggaagtgactttctgttgggatctgaagggtaaataggaaatagctaagcaaagaggatgggaagggaatgttctaggcagagtacataaattgtgctagggctctgggcgaggacagcatagtgaaatgggggctgaaagggggcaaacagtgaaggaaatactgtgattagagaagtggagacccagggaggggccagaacatacaggacatacgggctagataaaggattgtgttctttcttgtaagtaatgggaagctgtggagtattctaagtaactagtggatgatgtgattatatagaccctttgagaagattactctggccgtagttggaaagcagattgatgataggtaagagtggatgcagaggaatcagttaggagtcttctgtgggagggcatgatgatgggactaagaagacattagagtgatggagagggttacatggcattgaatttttgggagattccaagacttggtacaaggcctcagggacatttgctgagttagtgagttgcttggatataaagggtgagggtggggaaggaatacaggatgatgctgctgttcttggtgtcagtaactggatgagtggtgatgttcactgagctgtgaatattgagttatagaaagctacaggagaaacagttttgcagaggaaaggagagcatgaattctgtttgggcacaataggtttaaggtgcctgtgagatatccaagttaaaaggtgaaggaggcagctgaaagttcaataatacatatgtctggaccaaatatatagtatttcccacgtatggacagtaactaagaccatggggtccggtgagatcactctaatcattttttcatacagagctcactgcgtcttcatgtcaacttacctaaataagttacgtctttaaaattttatctagaacatgaaaatttagacaggttaaataacttccccaggtcatgcagctagtaagaggcagggttgagatcccatttcataggagatgcatcagtacctagtcatactgcatttccttaatcagaatgactgattctcagatacaatggagagttaaccatgtttgctaaggaacgaccaatgaccagctgagtgtatattttcttccattataaacatggcatttgagtctactattcttggaaagtcagtgaaaaaatatcccatggagtttatgattaagctctgagatccagattttgggtttactgcccaaacatctgtccccttgcttcctagaaaacatggaaactgaagttgaggttgcctggaagcttactaaaaatagtgagaaccatggaattgagaagttaaaacatgtttgaagtagtcaaatatatacctccacttttttgatggaaaacgttgtgtactaaaagtctaaatccatttcactcattcaactgacatatgtaacactgctataggccaaaccctttgctgggctctggagaggcactccttgttcttaaggtgctctgtctcataggggagactgacacaagttaaaggctattatagcattgtgagaagggtgctatgagaggattgcaaaggagggtatttcgtccatcattagagaaggggaaagcctttctcagaaagacttcctggaagtgataacacataaactaacaatttgagcctcaatttcttcataaggtagagttagttagataaataagagaggaaagaatactgtttcaggtacaagaaagaaacaggaacattttactataaggcaggaggataggaaaaaaagaccccatttagagaccaacaccttaatacacatgggttgtgtggttagatggttagcatggccttaaaattgttgctggagtttggcttttgagggacataaaggcataactgaagaacttcatactagttagggccacatactgaggtttgcatttttaggatgactatgttagcttttaagtagatgatgtgttggaaggggaagtacctagaggtggggaggactctacagaagttattgtaggagtccagggaagaaatacagagagaaatggcctgggcatggtggctcatactggtaatcccaattatttgggaggctatggaaggagggtcacttgaggccaggagtttgagaccagcctgggcaacatattgagaccctgtctctacaaaaaaattagccaggtgcggtggtgcacgcccgtagtccctagctactcaggaggctgagacaggagaatcacttgagtccaggagttcaaggctgtagtgagctataattatgccactgcactccagcctgggttacagagcaagactctatctgaaaaaaacacaaaaacaaaataaggagataaacaaatagatttgagaggtatttagtgggtggaatcaacaaaacttggagattagagggagaagtgggaatatagggggacttagagggaaagtggtgatctttacttagccaattatgcgaaaagattaatttagagtgggtaaaaagttaaattttagacatggtgagtttggccatagaacatccaagcagatatgtccagtaggtgactagcattataaattttgagctcaagagaaaggcctgggctggaaatacagatcagggaatcacggccataaagactggggacttgtcatcatagagattaggaagttatcctcatagagactagggcattgtgttagtctgtttgcattctttaaaggaatgcctgagactgggtaatttataaagaaaagaggtttatttgtcttatggtcctgcaggttcagcctgtaacatggtgcttgtacacaagcagtatagtgccaacatctgcttctggtgagggcctcaggaagcttacaattgtggcagaaggcaatgggcatatcacatggtgatggagcaagagagaaaggaggaggtgccaggctcttttaaacaaccagctcttgtgtgaactaacagaacgagaactcgctcattactatggagaggacaccatgccattcatgagggatccacccctgtgacgcaaaaacttgccactaggcccaccttcaacattgaaggtcacattttaacatgagatttggaggaggaaaacatccagactgtgcatcatcgccatagagagtaggatgtcattcctatagaggttggggagttatcctcatagagattaaggacttgccatcctcatagtgagtagggagttatcaccattcagttggcatatgtagataaaatgagatgaaccaacatcccaagatggaacgctgtggatcattcatatttaaagggtatggtgtaaaagagaagctggcaaagtaggggaagtaggatggttattggaaaaacctggtgtcatgggagccaggaaaggagagtgcttatgtactaagatgtcaaatgtcagattgcacaagaaatgtagatactgagatgtgtccactggatttggcactatgaggttgttggtgatatttgtgtgaacagctttagtggaatgggatcaggagccagatacagtgggttcagcaagtagggaggtggagtttagaaaggcacttattgccaggagaattttaaaaaaaagcaagttagagaaagtcaagtaataagaactagtgtggcatggatcagctctctgggaatgctggagggagagaactgaaggggagagaagtggaataaacactataaaaagctctgagaagagaggatgtggcttcaccccacccaatcctgagagaatgggtggagggtaggcctaatattgtcttgttatccaaatattgtctttaccagctatcctttccctaaagatgggacaagccattcccagaggtcagttccaggcaacatgaccttcccagaaggtggggtaaaattttcctcattaactcatgtgttccccagagtctttgggtttttaggaatttctacaaagaatttcaaatattttacaagtcatttccaagtaccataatatattcttccttcagtttggtatctcaagcttttgttaaggtagagacacattttccttcactcagaacattgttgtaactctgaaggagaaaaggcatgtggaattactattgtctgcattggccttccttctgtggctgcaccactcctacttctgtgaatctgagcaaataagaaaacagaccacctgcatgtgagcaagaagcacacagattttgctgaatatgtggcttcagtggtcttcacgttgcttctgtgttctataggtagcccggttttatacagacagacaatctatttcacctgatggaatgaaaaggataagaatcatgtgaaaccaaacacataagagatggatgtgtaaggcataatacccatttagggattaacaatatcagctcattttttaaacttttaagctcaggggtacatgtgcaggtctgttatataggcaaacttgtgtcatgggagtttattgtacagattatttcatcacccaggtattaagcctagctcccattggttatttttccttatcctctctctcctcccaccttccaccctccaataggccctagtgtgtgttatgccactttatatatccatgtattctcatcatttggctctcacttataagtgagaatatgtggcatttggttttttgttcctgcattaatttactaaggataatggcctccagctccatgcctgttcctgcaaaggacatgatctcattcttttttatggctgtatagtattctgtggtgtatatgtaccacattttctttatctggtctatgattgatgggcatttaagttgattccgtgtctctgctattgtgaatagtgctgcagtgaacatatgtgtctttatgatagaatgatttatattcctttgggtatatatccagtaatgggatttctgggtcaaatgttatttctgtttttaggtctttgaggaatcactgcactgtcttccaaaatggttaaactaatttacactaccaccaattgtgtataagcgttcttttttctccacaaccttgccagcatccgttatttttttactttttaatgatagccattctgactggtgtgagatggtatcttattgtggttttgcattcctctaatgatcagtgatgttgagctttttttatatgattgttggccacatgtatgctttattctgaagagtgtctgttcatgtcctttgcccactttttaatggggttgttttttcttgtacatttgtttaaatttcttatggatgtcagatattagatctttgttggatgcataagttgcaaaaattttctcccattctgtaggttgtctgcttactctgttgatagtttattttgctgtgtatcgggggaaccagcccccaatatttcaacatacgttctttctattttccctaagtgttggccggtctgagaaataaagagaaagagtacaaagagagaaattttacagctggtcttccggggatgtcatcacgtattggtaggactgtgatgacgaccctgagccgcaaaaccagcaagtttttattagggattttgaaaggggagggggtgtatgaacagggagtaagtcacaaagatcacatgcttcaaagagcaataaaggtcacaaggcaaggcaaaattagaattactgatgagggcctatgtcccactgtgcatgcattgtcttgataaacatcttaacaggaaacagggtttgagagcagacaaccagtatgactagaatttaccaggctggaatttcccaatcctagtaagcctgagggtactgcaggagaccagggcgtatttcagtccttatctcaactgcataagacagacattcccagagtggctgtctatagacctatccccaggaatgcattccttccccagggttactccttgctgggaaaagaattcagcgatatttctcctactcacacatctatctataggctttctgcaagaagaaaaatatggctgtattctgcccgaccccacaggcagtcagaccttatggttatctttcctcgttccctgaaaatagctgttattctgttatttttcagggtgcactgattttatattgtttaaacacacatgttttacaaacaatttgtacagttaacacaatcatcacagggtcctgaggtgacatacatcctcagcttaagaagatgacaggattaagagattaaagacaggcataagaaattataagagtattgattggggaagtggtaaatgtccatgaaatcttcacaatttatgttcagagattgcagtaaagacaggcataagaaattataaaagtattaattttgggaactgataaatgtccatgaaatcttcacaatttattttcttctgccttggctccagctggtccctctgtttggggtccctgacttcctgcaacagctgtgccgaagctttttagttccattagataccatttgtcaatttttgcttttgttgctattgcttttggtgtcttcctcatgaaatctttgcccattcctatgtctggaatggtattgtctaggttgtcttccaggatttttatggttttgggttttacatttaggtctttaatccatcctgagttaacttttgtatatggtataaggaaggagtccagcttcagtcttatgcatatgtctagccagttatcccagcaccatttattgaatagggaatcctttccccattgtttgtttttgtcaggtttatccaagatcaggtggttgtagatgtgtggccttatttctgggtcctctattctttttatttttatttattttttatttttatttatttatttttgaggcagagatttgcttttgttgcccaggctggagtgcaatggcgtgatctctgcttattgtaacctctgcctctgggttctctattctgttccattggtctatgtgtctgattttgtaccagaaccaagctgttttggttactgtaaccctgtagtatagtttgaggtcagatagcgtgatgcctccagctttgttctttttgcttaggattgccttggttatttgggctctttcttggttccatatgaattttaaaatagtttgttctagttctgtgaagaatctcaatggtagtttaataggaatagcattgaatctataaattgctttgggcggtatggccattttaatgatatggattcttcctatccatgagcatagaatgtttttccatttgtttgtgtcatctctgactttttagatttattctgatccaaatgtgagtgaccatggcctgtcagccctcgggaggtcctgagaacatgtgcccaaggtgatcggggtacagcttggttttatatattttagagaggcatgagacattaatcaaatacatttaagaaatacattggtttgtttcagaaaggtaggagaactccaagtgagggctaccaggctataggtaaatttaaatgttttctgtttgacaattgcttgagtttgtcaaaagacctgagatctataaaaaggaatgttcaggttaaagataaatgattgtggagaccaagttttattttgcagaggaagctctcagatagcacacctcagagagagagagcaggttgtaaaatgtttcttttcttttcttttttcagggtaattagcatatccatgaattttttttttctgttttgaatgatttatttcccaccttctttttttaaaattatgcgttaagttctagggtacatgtgcagaacatgcaggtttgatacataggtatacatgtgccatgttggtttgctgcacccatcaactcatcattcacattaggtatttctcctaatgctatccctctccaaaccccccacaccatgacaggccccggtgtgtgatgttccccgccctgtgtccaagtgatctcattgttcaattcccacctatgagtgagaacatgtggtgtttggttttttgtccttgtgatagtttgctgaggatgatggtttccatcttcatccatgtctccgcaaaggacatgaactcatccttttttatggctgcatagtattccatggtgtatatgtgccacatttttttaatccatcactgatggacatttgggttggttccaagtctttgctattgtgaatagtgccgcaataaacatacgtatgcatacgtctttatagtagcatgctttataatcctttgggtattgctggtatagtttgaggtcagatagcatgatgcctccagctttgttctttttgcttaggattgccttggttatctgggctctttcttggttccatatgaattttaaaatagtttgttctagttctgtgaagaatctcaatggtagcttaataggaatagcattgaatctataaattgctttgggcggtatggccattttaacgatatggaatcttcctgtccatgagcatggaatgtttttccatttgtttgtgtcatctttggctttttagattgctgggtcaaatggtatttctagttctagatccttggatcaccacactgtcttccacaatggttgagctagtttacactcccaccaacagtgtaaaagcattcctgtttctccacagcctcgtcagcatctgtcgtttcctgactttttaataattgccattctaactgatgtgaggtgatatctcattgtggttttgatttgcatttctctgatgaccagtgatgatgagcattttttaatgtgtctgttggctgcatagatgtcctcttttgagaagtgtctgttcatatcctttgcccactttttgatggggttgtttttttcttgtaaatttgtttaagttctttgtagattctgaatattagctctttgtcagatgggtagatcgcaaaaatttcctcccattctgtaggttgcctgttcactctgatggtagtttcttttgctgtgcaaactttttagtttaattagatcccatttgtccattttggcttttgttgccattgcttttggtgttttagtcatgaagtccttgcccatacctatgtcctgaatggcattgcctaggttttcttctagggtttttaaggttttaggtctaacatttaagtctttaatccttcttgaattaatttttgtataaggtgtaaggaagggatccagtttcagctttctacatatggctagccagttttcccaggaccattcattaaatagggaatcctttcctcatttcttgtttttgtcaggtttgtcaaagatcaggtgattgtagatgtgtggtgttatttctgaggccactgttctgttccattggtctgtctctctgttttggtaccagtaccatgctgttttggttactgtagccttgtagtatagtttgaagtcaggtagcgtgatgcctccagctttgttcttcttgcttaggattgtcttggcaatgtgggctctcttttggttccataggagctttaaagtagttttcttccaattctgtgaagaaagtcattggtagcttggtggggatggctttgaatctacaaattaccttgggcagcattgattcttcctatccatgagcatggaatgctcttccatttgtttgtgtcctcttttatttcattgagcagtggattgtagttctcttgaagaggtccttcacatcccttgtaagttggattcctaggtattttattctctttgaagcaattgtgaataggagttcactcatgatttggctctctgtttgtctgttactggtgtataagaatgcttatgatttttgcacattaaatttgtttcctgtgactttgctgaagttgcttatcagcttaaggagattttgggctgagacaatggggttttctaaatatacaatcatgtcatctgcaaacagggacaatttgactttgtcttttcctaattgatacttctttctctggcctgattgccctgtccagaacttccaacactatgttgaataggagtggtgagagagggcatccctgtcttgtgccagttttcaaagggaatgcttccagtttttgcacattcagtatgatattggctgtgggtttgtcataaatagctcttattattttgagatatgttccatcaatacctagtttattgagagttttcagcatgaaggtctgttgaattttgtcaaaggctttttctgcatctattgagataatcgtgtggtttttgtctttggtatagtctgttgatttgggatggagagttctgtagatgtctattaggtctgcttggtgcagagctgagttcaagtcctggatatccttgttaaccttctgtctcgttgatctgtctaatattgacagtggggtgtaaaagtctcccattatcattgtgtgggagtctaagtctctttgtaggtctctaaggacttgctttatgaatctgggtgctcctgtattgggtgcatatatacttaggatagttagctcttcttgttgaattgatccctttatcattatgtaatggccttctttgtctcttttgatctttgttggtttaaagtctgttttacaagagactaggattgcaacccctccttttttttgctttccatttgcttgttagatcttcctccatccatttattttgagcctatgtgcattcgtttcacatgagatgggtctcctgaatatagcacactgatgggtcttgactctttatccaatttgccagtctatgtcttttaattgggacatttagcccatttatttttaaggttaatattgttatgtgtgaatttgatcctgtcattatgatgttagctggttattttgcccgctagctgatgcagtttctttctcgtatcgatggtctttacaatttggcatgtttttgcagtggctggtactggttgttcctttccatgtttagtgcttccttcaggagctcttgtaaggcaagccttgtggtgacaaaatctctcagtgtttgcttgtctgtaaaggattttatttctccttcacttatgaagcttagtttggctggataggaaattctaggtcgaaaattcttttctttaagaatgttgaatattggcccccattctcttctggcttgtagagtttctgcccagagatccgctgtaagactgatgggcttccctttgtgggtaacccgaactttctctctggctgcccttaacattttttccttcatttcaaccttggtgaatctgacaattatgtatcttggggttgctcttctcgaggaatatctttgtggtgttctctgtatttcctgaatttgaatgttggcctgccttgctaggttggggaagttctcctggataatatcctgaagagtgttttccaacttggttccattctccctgtcactttcaggtacaccaatcagacatagatttggtcttttcacatagtcccacatttcttggaggctttgttcatttctttttactcttttttctttaaacttctcttctcactttatttcattaatttgatcttcaatcattgataccctttcttccacttgatcgaatcggctaatgaaggttgtgcatgtgtcacatagttcttgtgccatggttttcagctccatcaggtcatttaaggtcttttctacactgtttattctagttagccatttatctaacctaaggtttttagctttcttgtgatgggtttgaacatgctcctttagttcagagaagtttgttattactaaccttctgaagcctacttctgtcaactcgtcaaagtcattctccatccagctttgttccattgctggcaaggagctgcaatcctttggaggagaagaggtgctctggtttttagaattttcagctttcctgctctggtttcaccccatctttgtggttttatctacttttggtctttgatattggtgacctacagatggggttctggtgtaggtgtcctttttgttgatgttgatgctatttccttctgtttgttagttttccttctaacagtcaggcccctctgctgcaggtctgttggagtttgctggaggtccactccagaccctgtttgtctgggtatcaccagcggaggctgcagaacagcaaatattgcacaacagcaaatattgctgcctgatccttcctctggaagcttcgtcccaaaaggggacccgcctatatgaggtgtctgctggcccctactgggaggtgtctcccagttaggctacatgggggtcagggacccacttgagggggcaatctgtccgttttcagagctcaaacaccatgctgggagaaccactgctctcttcagagctgtcagacagggatgtttaagtctgccgaagttgtctgctgccttttgttcagctaagtcctgcccacagagatggagtgtagaggtagtagggcttgctgagctgcggtgggctctgcccagttcgcacttccaggccactttgtttacctactcaagcctcagcaatagtggatgcccctcccccagccaggcttccaccttgcggttcaatctcagactgctgcactttcagtgaacaaggctccgtgggtgtgtgacccgccaagccaggcacgggagagaatctccttgtctgccagttgccaagaccttgagaaaagcacagtatttgggtgggagtgtcccgttttccaggtgtaatatgtcacagcttcccttggctaggaaagggaaatcccccaaccccttgtgcttcccaggtgaggcgatgccccgccctgcttcagctcaccctctgtgggctgcacccgttgtccaaccagttccaatgagttgaaccaggtacctcaattggaaatgcagaaatcacccatcttctgggtcaatcacactgggagctgcagactggagctgttcctattcagccatcttggaatggatccttctctgacttttttgagcagtgttttgtagttctccttggagagctcttcctgctttggctctcagcttgactgatgttggtgtatggagtgttagggagctttgcacattgattttgtattctgagactttgttgaagttgttaatcagcttaaggagctttggggctgagaccatggggttttctaggtataggatcatgttgtctgcaaacagggatagtttgacttcttctcttcctatttggatgccctttatttccttctcttgcctgattgccctaaccaggacatccaatactatgttaaataggagtggtgacagaggacatccttgccttgtgccagttttcaaggggaatgcttccaggtcttgccatttagtatgatgttggctgtgggtttgtcatagatggctcttattattttgagggatgttccctcaatacctaatttacagggagtttttaacatgaagaggcgttgaattttatagaaatccttttctgtgtctattgagataaccatgtggtttttgtctttaattctgtttgcaggatgaatcacatttattgatttgcttatgttgaaccaaccttacatcgcagggataaaggctacttgattgtggtggataagctttttgatgtgctcctggatttggtttgccagtattttgttgaggatatttgcatccatgtttatcaaggatattggcctgaagttttcattttttgttgcatctctgccaggttttggtatcaggatgatgctcatatgcctcgtagaatgagttagggtgaagtccctcttccctattctgggaatagtttcagcaggaatgataccaggtcttcattttttaccttgtagaaaaattgacatggcaagacagcttggtagacatgaaatcagaagtgggggagttagtttgattatcttagaggaggcattcttcatcactgtaggggaaaaaactttcaaggaaatggtgtacttgagtccacatgccaaggcaccttctttccccagaccatgctagagatactttgacagattattttagttgctttttttttttttaataattttgttgatcattcttgggtgtttctcggagagggggatgtggcagggtaataggacaatagtggagagaaggtcagcagataaacacgtgaacaaaggtctctggttttcctaggcagaggaccctgcagccttccgcagtgtttgtgtccttgggtacttgagattagggagtggtgatgactcttaactagcatgctgccttcaagcatctgtttaacaaagcacatcttgcaccacccttaatccatttaaccctgagttgacacagcacatgtttcagagagcacggggttgggggtaaggttatagattaacagcatcccaaggcagaagaatttttcttagtacagaacaaaatggagtctcctatgcctacttctttctacacagacacagtaacaatctgatctctctttcttttccccacatttcccccttttcttttcgacaaaaccaccatcgtcatcatggcccgttctcaatgagttattgggtacacctcccagacagggtggcagccgggcagaggcaccccccacatcccagacagggtggccaggcagaggcgccccccacatcccagatggggtggccgggcagaggcgccccccacccccaagacggggcggccgggcagaggcgccccccaccccccagacggggaggccgggcagaggcgtcccccacctcccagacggggcggccgggcagaggcgccccccacctcccagacggggcggccgggcagaggcaccccccacctcccagacggggcagatgctgggcagaggcgccccccacctcccagatggggcggatgctgggcagaggcgcccccccacctcccagacggggcggatgccaggcagaggcgctccccacctcccagacggggcggatgccgggcagaggtgctccccacctcccagacggggtggccgccgggcagaggcgctccccaccccccagacggggtggccgccgggcagaggcgctccccacctcccagatggggcggctgggcagaggcactccccacctcccagacggggcggcggggcagaagtgctccccacttcccagacggggcagcggccgggctgagatgctcctcacttcccagatggggcagtggccaggcagaggtgctcctcacttcccagacggggcagctgccgggcagaggtgctcctcacttctcagacggggcggccgggcagaggcgctcctcacctcccagaaagggcggccgggcagaggcgcttctcacttcccagacagggtcgcagtcgggcagaggcactcctcacttcccagacagggtcgcggtcgggcagaggcactcctcacctcccggacagggcggccgggcagaggcgctcctcacctcccggacggggcggccgggcagaggcgctcctcacctcccggacgggttggccgggcagaggcgctcctcacatcccagacggggtggtggccaggcagaggcactcctcacctcccagacggggtggcggccaggcagagacgctcctcacctcccagatggggcggtggctgggcagaggtgctcctcagttcccagatggggcggctgggcagaggcactcctcacctcccagacagggcggccgggcagaggtgctcctcacttcctggacagggcggctgggcagaggcgctcctcacttcccggatagggcagccgggcagaggcgctcctcacttcccggacagggcggccaggcagagacgctcctcacatcccagatggggtggtggccgggcagaggcgctcctcacttcccagacagggtttagttgccttttttattctatgtagatgaccccatccccaccatattcacatattccttcttcactcaggtacaaaattcagtaggacacgactttctgagtcatatgctggatttgaggagatactgaagccacaagactgaaataacttttaaactgtgggtgatttggctaaaagctactctcatctattatatattcatcttactagttttgctctcagaggaagttcctgtttccaaggtaaaggaacctttctctaactccacctaccttcctcctcactaaatgggtacagaaaatatgcttagaaaaaaacgcagaggaccctgatattgtcattctgaaatatcagtagtatctgtcacattttgacaggaactagatactaatcaatttataagattgagttttcatgtttctaaagtgcagatactctgtgttgatggttaaagagaaagccagctggttaggtgtcagatgatctctgacagtgttaccatagacatttaattgcatgaccatatcttatccagatggcatttctcgcttacacagatacataaccccagaggggcagagggagagatgtcaaatttccctcaaaatagaactttgagtccacccaaagtctaccaagtgagactttacaattctgcccaaagagtacagaaattacattgatctggcaagaaagaatgaatgggaacccaaaggtagctgcttgagttaatcaggttggtgagtggctgacagggtgctagagtgggcaaagtcaacattaaaccaccagcgcacaacttcctatgtacccaatgttcaccttcccagctcctatcatctttgccactttactctgaactggaaaccctctgtacattttttcctctttaactcaaagcctttagaactctcgagctcaagcagtcccctcctgcctcagcctcctgagtagctgggaccacaagcacacgccaccatacctggataatttttaaattttttgtagagatagggtctctccctatgttgcccagattagtctcgaactcctgggctcaagtgattattctgcctcggcctcccaaagcactggggttatgacccaccacgcctggccccacatcttgtttttcacataatgaaatgttttgaagacagtttgtgtcaacattcatagatctagctcagtctttttcatgtctgcatagaattatgtattatgaatgtggtagaatttatatatccagacatcagttgatggacttttagtcatttttagtcttttgccattacaaacaatgctgcactgaatgtcgctgtctatgcaccattttttcacatattcataagtatatcagcaggttaaatttctagaattagaattcttcagtcaaaggatatatgtgctttaccctttgatagatgttactcaattgcctccccatcaaagaggttctacaaatttttactcctacaaacatacaagaagtatctgttttcccacatctttgtcaacatatataatttctttactgaatttacagtaaaattcactttttaaggtgtaaagttctatgaattttgacaaacatataaagtcatttaaccaccatcacaatcaaaatctagaatatttctattatttccaaaagctcctttgtggccctttgtagtcaatcctctgtgcccatcctgagcctttgcctactgatctaatttctgttcttagttttgccttttccaaaatatcatatcaatgaaagcacaaagtaaatagcctgtttgagtctggtttcttttacttagcataatgcttttgagattcatacatattgttacatttatcagtagtttattccttttccttattgctgagtagaatttcattgtatgattgttcccaatttgtatacatttgccagttgctagcatttggattgttttgaggttttggcaattatgaataaagcagttggaaatatctaggtacatgtctttgtgtggacataggtctttgcttttctcaggtaaatacctcagtgtgggattgctcaattttatggtgagtttttatttaactttataagaaactgccaaacactttctcaaagtggctttgttatttcccatccctagcagcaaggcacaagtgtttcagttgctctgcattcttaccaacatttcatattgtcaatatttaaaaaattttggccattctaataagtgtatagtgaatattatgtatttatcaaactttaaaaatgttgctattctgaaaattatttttttcatttacatttctttaattaagggtagttagaatacatttaatatgttgataacacatatttctttttctttgaattgcctattcatcttctttgccatttttctattaggtgagctgatcattttcttaatgattttaaaatgacgcttatatattagtgaatccaactatttcataattgttgcaaacttttgtcattttttactttgatttgttaacttacagaaatacaatttacaaattttgaagagaagaggagactttatttcttataaaaggttacagcctgcaggatggccattttgacaggttgggaagtatagcctccagtcagaagccagaaacatatctggagggaggggcaaagggaacaggaatttacacagagctggtggccaaatatacatattcaataagctatagaaggagtcatgaatatttatgaagggagaaccatctgcatgtgtaattgagccttctgcttctccatgttcaaaaaatggtggtgaccttaggtggagtttttggccctctgacatcaaaacatgaagcagaggatgtgaaaacactagctgcctattcttcatagactggccagaaccaccccatagttagtggtctcttatcaggcagaaaagatggggcagcatcagggagtcggttgatatcagtggtggagccttttgaaagggctggtttctgttaggcccttgagaaggaaagcctactcctggttagcaagggagagggtctgagcccctcccaccctccattccatcttggccgagaacgcagttttcaaggtttctctggggtccccttggccaaaagatggtctggtcagttggggggcttagaattttattttgtatagcttatagcacatttttctatagtaatatttgtatgtaacctctaaattttgtacctcattggtgcaaaaataaggcggtataaatgagagagtttataaaggcaaggtatacaagacaagactataaggctaggcaccctggttgagtcagttcaccctgcttccactattatccagcactagagatgcatggccaatacagattttcttgcttattctcaccatctgcaaataaccaaggcttgttgacaaatgcagctgctttgagaaagggtagagtccccagggcacaatttttcaatttcagatgtggaagaagactcgtttagtggaagcaatgcgcttattgctgaggccatcaatataccagattgttacgccttttggctgggacacagggaattcctgtctgcagagtcagtgacatcactttgccggaaacagccttcctccctgccaaccctacacttaaacatgggattccacactgaccacaaaggcctattattctcaatgcaatctatgggcaaaagaatttgagggaggctagaaggggtgggggcaagagagaatggatggtttggttggaggaagtgagaagaatcagggaagaggactcttttgcttcctcatttcccatacatagagcctctgtcaccatttgatttttgcgatcattaacatttttagagtcaggtataaccaagtgcaaaccagttatgttagttacatgctgctaatctgagaagagtgtgttgcccaagaactgtgggtggggagcctcaggttggctgaatctgatttgcaggaagagcttgttctgcacccccacccacatctacactatctggatgtcaccaaataggctctccccacccaaagctgagtctcaaggggtccactcagtatcagccaggctacgttgttaagataaatgcaattgttttctaactaagaagctgtgaaccgagaataattggctaattaaaagttcaaagagtggaaataaaatagcattaaaaagagccagtaacttcctctgacgtctgtggttcaagagatcagtggaacaggacatgggttatttactcaattaccttgtctttctacctttcttttcattctcacccccaccccttcccttccttcttatttcctggctctattttcttacctgtgtctcccaacccaatgtccatctcatttttcctccttcttttttgccttttgccctttaactaactggttatcattgagatctttaggatcaaagtttgtctttagcagttgtgtttctattgatgtttgtgctgacttctttaagtaaaatataggcaggaaaaaacccgctaaattaaactgctttatccttgaatgtgactctggattggttaattggagaaatatggggttggggtagaataagacctttccatttagatagaattttggactagtgcttttgcattgggtcagctgagaaagaataaaactgaaaaatttctacgcatctctaatgcaggacaatgatttaaggcattgaagtggaactgagacacttggatcaaatccctgttctgccacgtgcaaggtgcatgacttgggcaagtcccttaagcttcctgagaaacacagtctcagccttttgtcacttaactgtaagcttctgactgtcagggatgagattcatgatttcaaaaggtaggacattggtatcctcagtgagaacagtccagacaacccttccagccaaatcctcaatgttggtcactttttatttctggataatgagattggctaccacataacagtactggtagcacagcccagacactgtatgagcctcagtcatgtattgtagggtagggtgctggttaaaagcctggaccttgaagccagaatgcccgtgtttaattcctggccctgttaccggtggcagctatctgagttactggcagtgtatccatacgggtctgcagtaacctcaattcttgcctcatcagaagaaagaatgtgagggatataaagtagaaaaagagactgagtcaagtttcagagcaggactggaagtttattgaaaaggctttagaacaggaaagaaaggagagaacccttggaagagatccaagtgggcaacttggagaacaaacaacgtgtttagctgtgatcctaggactttataggcggccatcttgagcccttttcccgtgattcttcccttagggtgggctgcctgcacgcacagtgccctccttacctccttgagcacacagtgtgtttaggaagttgtgtgcatgctcatctgaggctttctttccttttccggtggagtgctcccggcaagtcatcttccaccttttgtctcttaatgtgcatgcccaggaagttgcttctccctggtgcttgaattcaattaacactttaatgttacagctgtggatcagcagattttctctccctggctccagctgccaaattatcatttttagagaggcaatgtgataactgtcaaaccatcacctgatatttctagttggtgggggagaagagccctttcctgccatgtctgtctaactacatgtaacagcgcaacatttacatcagtgtaactttgggaagttacttaatctctctgtgactcagtttcctcatctgtaaactaacaataatgataattataatagtgactgtgagtgtgactttatttggaaatatagtagggtgttcagagatgtaattaagctaaggatcttgagatgaaatcatcttgaatttagggtgggccctaaatctgatgactggtgtccttatgagagaaaggagaaggaaacgtgacacaaagagcaacagggggaaaggccatgtgaagacagaggtggagattggagtgatgcagccacaagccaaggaatgctaagaagctgaaaaagacaagaaagacatctcctccagaaccttcaaagggagcatgcccctgctgataccttaacttttggacttctggcctccagatttatgaaagaatacatttctgtttgaagccagcaagttcatggtaacttgttgtggcagccctaaaaaactaatacagattttatagagaagatgatagtattacgtgcaccttataggattgtagtgaaggctaaattgatggctgcatttaaagtgctaagagtagaatctggaatatagtaagaactctttagtataggctattacgtgttgttagctcattgaaccttacatagcaaccctatgaagcagatactattgtgactcccattctgcccatgaggaaatggaggcttacagagactaagcaaaggtaagcttatctgaactctgctctagcttgaaccatcccccagaagtctgtggagtttgactaactgctgatggatcctgatgattgttggctcggtgacccttcctgatgatggtctctcagaaaagactctccagtgctgagccatcaagaagtctagaaggcattgagaaggctgtcacatgtgattatgtttactcctcctggatgcgtctgcccagacctggttttggcacaagctctgctctgatggagccaggctctgtccacacttggctgtgtggcctgacctcatttgagtagcctcagcacatcattaccacaagaggcagggatgtgccaccctaaaaggccacaccctctctctccagtgacttcaacagcccccaatggttccttgttcacccctaagttgctaagcatagattatatgaatgactttagaagtaagtcacatcactcagaataaggcaaagccctcactagtgccctcaaggccttatgagcaggggaccccattgatcctctgaccagttcctactactctcccctcagggcctttctgtgtacagttccagatgctgtaaagctcttgcctcagaggtatgcaggctttctccctgtgatagaaatcaccttctcaggccagtcctaatcactgcatccttcctttttaccttccttgctttttcttcctcctcagcacttaaaattatgtaatacactgtaaattttgtttatcttgcttattgtatttttctcccaactagaatataagcaccatgaggatagggacatttctcactttgggttattgctgtagctcagagcctagggcaggtctagttcatagtaataatgtgttcaataagtaattattgagtgaccaactgaaaaaatgaatgaggcatagtcccctctccaacaactatagaactcccaaactgaaatggttcaagctatatctagaggtagcacatgaagagaggactactgacataactgagctttgtagagtatagggggagcatagcttccaactgagcttgattttgaaggagacaaaaagacttggagaatgaggggaatggaattacaaatgaaggcgtcccacactgagaaaagttcagagaatccaaaattcattcattcattcattcattcatacaacatgggatataccaatgaacaagccagaaaaaagtccctgccctaaggagcttacattctagtagtcataatgtcaggaattctcatcttggacccaaacagatctgttggttggaatggtaaaatgggaagggctgaaatttctgaagggcttggaggtctaggtagaccagtgtagctttcatctggcacacagcaggacataggttcttgataaggtagagtcttaggaacgtcaattgtggaagatttctatagccacatgaaggagggattctgatagagaagataattaggaagtgtgggagtcaccagaaagggccattgtagaagatcagatatgaggtaagggtgactggaatcaggggatgtggatatcactatagaagaaggtgggtctaaggggcttgggatgaaataactgagagaggatcttcaagcccctgagtgtgagaacaacctacatatgtgtcctcaagaagagttccctgatggagaagaaggaaggtagcaggggtggtgtggagactttgactctgtgagttggaggaacgacaacgccagattaggaccagtcttctgagcttcagtgattgttccatcattaggctatgtaaacacaggaaggaccacaacattccttgaatgtttgctcaccaatgcttgtccacatttgctgttttgttctctatatgacaagaaaagtttagtccagatgtgactcataacaaattggaaacaatttgaatctagtcagtcacattggatctgcaaagcaaaacttttttttgcctgaaatccaccacatctgtcaacaccccaaatctgtttattaatggagtaaaattttaagctgttatatttttgttatcacagagtagcaatgctgggatttctctatacaacagaattttgactatggacaaaattaaataatttgtttgtttgttttggagacagggtctcactctgttgcccaggctagagtgcagtggtgtgatcttggctcactacaacctcggtgtcctgggctcaagcgatcctctcacctcagcctcccaaatagctgggactacaggcatatgccaccacgcctggctaatttttgtattttttttgtagagacagattttcaccatgttaccccccagtctcaaactcctggactcaagtgatccgcccacctttgcctcccaaagtgctgagattacaggtgtgagccactgcaccctgccgagattaaataattttgattttcaccttagtatgattataactggacatcatgatggctgtttctataagaatcaaaagaacctttgcttcctttgattcttataaaagtcttgaaggtatttttcctctgacacagctaattggcttgaaatcagcctgtgttttttcaaagcttgggtttccttcagttttatctctctgtcaggtgaagagttgaagttaatattaccttgctctctcactttaagctgaaaattcccctcccttgtcacatcacatgaaaagaaaaaaatgcaaaggaagtggccgtcttaaattctccagtacagtaagccaattcaaagggaaaacaatgacaacactttgccattggatattttggtaaaatcatttgttgaaattctgtttcgaaataccatttcacattgtatgacagaaaccacatttctgttatccacaaggcaaattaagggcttttcagggggaagacaatcaatgtgaattttccataatagagcttgactgtggcagtcatgggatctgaaagcactctgggggtctaagaagaaggggcagttacctaagtaattctctttttatgaacacatccaagatatgtcaacctgcaccccacctctagcacctcttctttggcaccacttctgagatgactctcctgcttcctggatgtgatcagggcttttgaaaactggctgacatatagtccatggaagatagcattttaattactgctctctgggtaatgtagtcagttacatgaaaaacaaacttaaccattgtgggttcttttggtaataaaaacatttgaaaaatcatgtatgaaaaattcctaaattttctctctgacctaaaaatctttttcttattatatctttaataagaaataagagtaggatgaaaggcttgcatatattctggtaacctggatatcattgcaaaagctgggaaaatgtggaaaagtgtacatctaactcctcaatgacaagaagaagttagtaaattttctcgttaggaaaaggaagaaataattatagtcacatcaagttggttcccacctctgggttcttgcagtttctgttccttcttcctcttatgttcttactccctctccaggctggtgttttctcctcaaatgtcaccttcaaggtctcggctcaaatgtcatcttctgagagaggctttcttgaccctcaatctgatacctttcccttcattcccaattctaccgcaagtcactctatcaagttccttggtttgaatttcttcttagcacatattgtgacctgaaatcacctatttatgtgcttcttttctggtttatctgtcttgctaactagattgtaaattccaaagagcaggggccttatcagtttttctttttttattgtagtaacttggatgctaagaatagtgcctgaaatggccatggaaggaaaatgagattgcaagattgtcatatttacaaaaacaaaagaagttaacaagtagaccttgttgaatagcttgagggagtaaaacattcaaaattttattatggtagaaacattgctacagtttgtttgttgttatatttataattggttgttttatttataattgcttatctaaaggacatgctgcttagggctgtgtttgtcaacatcacaacgttgggaaccaaagtggggtgcccttagagggttcttttccagattccagaacactggcatcaaagaggacatctctcccataccagttttatccagatgttttagcttcaagtagttaaaatcctgactctaattgggtcaaagcataagttttatggaaggatgggctcagcatttgttgatttagcagcttaaaatgccatcaaggactcacgttctctacatctctctgctctgccatcattgaatgccatcccttccaggcaggacaatgtttgaggatgaagagagaatgttttcttttttccctagacttgccccagaagacttcctccacggtcacatgggccataattaggtggcatacccattattaaaccagtcactggtgagggaatgaaattacacagacaagtccatccctgagcttgggggaaaggcaagcatctgaacaaaatggagtttcttttgggaagggagaagcagggaagtgctgtgtatttcacctgctcttccttgtttggaagcaatagataatgatgttgctaaaactttttctcctaaattttgtattgtttggtctgatgggtaaagactgcctcaagattctggggattgaggtggattggagacccataccttaatccaagcttagacttggattaagttcaagcttctgctcaagagcttcagagagagctcccatttcagtgcccagccagcttctacgtttgggaatagtttggggagttgagagaggaggaggttgagttgtcaaaatggagggaatggtgcaaccatttcatttcctgttcacttcctctatgcaatctgtttacatctgaccaaagtagcttttgccttttttttttttttttttttttgagagggagtttcactctgtctccaggctagagcacagtggtgcaatcttggctcacagcaacctctgcctcctgggttcaagtgattctcctgcctcagcctcctgagtagctgggatggcaggtgcacgccaccatgcccatctaatttttgtattttcagtagagacggggtttcaccatgttggccaggatagtcttgatctgttgacctcgtgatccacctgcctcagcctcccaaagtgctgggattacaagcgtgagccacggcacccgtttttggttattatttttttgagatggagtcttgttctgtcgcccagcctggagtgcagtggtgcgatcttggctcaccgaaacctctgcctccggggttcaagcgattctcctgcctcagcctcccgagtagctgggattacaggtgcccaccaccatgcctggctaatttttgtatttttagtagagatggggtttcaccatattgacctggctggtcttgaactgctggccttgagatccacctgcctcagcctcccaaagtgctgggactacaggtgtgagctgccgtgtccggccacttttgccttttatataattctactattggagcttttctaatgtcccatgacagaatgagactaaagacaaaataaataagataatatgaattatgatccaaaatgttcaagactcctcagcctctatgccattaccaattgcttactatgtaagggtggtttaaatgcaaggggtatgtatgtcaagccaggaaatgtcatggaatagtgggatttgttgtttgatgatacattcttaatactttttaacatcataaacattttgtggtagatttcaaaaatgaggaggggtattcttgttttttgttatttgttacttctaccttgatagatctgtgtgaactgttaaacagccaatttggggctcttctcactcctcattccatatctgatcactgacctagttttgtccttgccacagccactaactcagtcttggcctttgtcaaagtacaaacaaatccttttgttcttgaattatttcccaattactctgtaagtacctcattgataaaaaagattggcttttaatctgtctctgatgtctccaggtagccattacaagaccagacagaaaggggaggaaaatcagtgtttttgatttcttgttggtatttttttcttctgcttttggttttagagtctaacgtgaagacattttgctccaagaatatcctagccatccttggcttctcctctatcatagctgtgatagctttgcttgctgtggggttgacccagaacaaagcattgccagaaaacgttaaggtaagtcaaatatatctgtgtgtttgtgtgtatgtaagaggagatctgggtgggacagggggaggagggataaggtatgtagagcataggggacgagttgaggttctaacagcccaggaacaagtcaatttccactggattaggggagtaaaatggaaataggtgctcattctagaagagtaaatgccttgaatcattagtggtgggaagttaactgcctttatgattgtttagtaaactcattaaattgatactctagcagagatgaatgctttattcaccttatccagatctgtgtaatactatgccaagattctatattctagtatatttccacttcttcatcatgggtgaatcacaatactgcactctgttctttttacttcattattatcactatcaccaaaacaataacgtttattatacaactctgtataaagtactttggaagtcagagattgaggagaagacatgtttcttatctccagatatagtaaagaatcaaaatcaataaaagcaaatcagaaaacatatacgtgtatcaggtatagtcatttgaaatgaattcatggataggcagatttcttgtgacatttctacatttgaacaactagttaatatcattaaagatcattaggatcattaactttaatgtatttatgttttctttccagttcatcaaagtaaaatttcagacatgaatatctcacaagtactttgtaatatggtcattatattttttaatctgttaattaaaaagcatgtggtaaataaaaatttatactataaatacaccattttaaactttcactgaaattatagtaaacaaatatataagggcccagatgataccaatatgctaatatgcatgtatgtacacatgggcagtaatatatctagaagttaacttgaccatggaggcctgggaatacatgtgtagaagtatattctcttgtatttgaagatgttgaactgggagcctggaaggatggttgtgtatgccaggcctctgaaacttttgccatccacccaaatcactgtatagcagaggcgtgggtgtcacactggcatctttttgtcaagttcaacccagtggtgctgtgtacagcagtccctttgtcaagacagaaggctgatactatctcattgttaagggtcgcttgccttttaatgttgactgatgttgtttccttggcaaaacttcactcacagttgaagcctcatgacatcttggttccattatttgtttaccagctccaaaaatacatggttgccttcttaatttgacctttttacatgttcagtattgcatcattggagagggggatgcctaggaggcaaaatccatgacaaacttgagttatgttcccaagaatatgtgtggtcatggacgaccttccctcattcacagtggtctcctttaagtctcttgtgcttctgcattgttatatgggcctggcaaaatggaacaaggtctttggcattctttaaataaaaggtaggagtattgaagagcagtcattggcatctgaagtgaatctttttaataacatcactgatttattttatacaaagatagttttatatatgcaaactagccatttgttgaggttatataataattttagtaagattcctggcatatattgggggcaaaatatttcaggaacttgtattctggtgatggctttaaaccagatgtgctgtccaatttgatagccactagccacatgcagctctttaagcttgtcaattaaaattaaataaaattaaaaattctgtccctctgttgcactagccacatttcaagtgctcaatagccatacatggctggtggctactgtattggacaacacagatatagaatattgccttgctgtagaaagttctattggacattgccactttaaagcatactcttgaatgataactctgaagtcattcaaaactaagtttaatgaatagggtgtatgataaaacattttataaaatctagaataagaaacaaaaaaactttttttcttgcatggtttgtaaactagtaccaggatcatcccaaatatcatgggctactaaactggtttgagtagtttattgaaataaatgtatttgcttccaaaaatgaccatttaaaagataacacttatttggatatttgtactgatacatgttttttgtttgtttgtttgttttttgtttctttgtttggggtttttgtttgtttctttttcaagatggagtctcgctctgtcgcccaggctggagtgcagtggcacgatctcggctcactgaaagctccacctcctgggttcacgtcgttctcctgcctcagcctcccaagtagctgggactacaggtgcccgccatcacgcccggctaatttttttgtatttttagtagagacggggtttcaccatgttagccaggatggtcttgatctcctgaccttgtgatctgcctgcctcagcctcccaaaatgctgggattacaggcgtgagccaccgtgcccggctgatacatgtgttttgagagcacacaatgacatgactttatgaccatacttcattcagcagttcttcattcattttttataaatttatgcatcgacaattatttattacactccagtctggctgacagagtaagactctgtctcaaaaaaagtaaaataaaaaatattcattgtctgtgttaggcactgggctacacaatagggaaggcagtatatagatatgactgagcttaccatctggggaagcaaacatatttaataacacaaattattaattgtaattatgataaattgccaccaaatgaaagttttggggccaggcaagtcttccctgaaaaaatgatactaaaataatatctgaagaatgattggaagttagctgggaaagacataggtaaagggtagtccaggcagggccgagcacggtggctcatgcctgtaatcgaagcagtttgggaggccgaggtgggcagattgcctgagctcaggagcttgagaccaccctgggcaacatggtgaaacccaatctctactaaaatacaaaaaattagcttggtatggtggcgcgtacttgtaatcctagctactcaggaagctgaggtgcgagaatcacttgggccccagaggcggaggttgcagtgagccaagatctgccactgcactctagcttgggctacagagtgagacgccaactcaaaaaaaaaaaaaaaaaaaaaattccaggcagaaggaaagcaggtgcaagagtcctgaaacaagaaggagttggatatctcctaggaactagttggagagcaggagtgggccacgtgttatataaagatggggaggtacgtggtgcaggccctgcaagacaggttgaggatttcagttttaatcctaagagtagtgggaagctagtggtatgatcagatttgtttttgcaaagatcactctgatttcaatgaattagaggaggatgagatataggaggataccaggaagaggctacaagaaaaatgtggaaggagggggagcctttgggttcaatttttgaagaattgttttgagtgttggaaagccaatgggaaatgtcaagaaagcagttggataatcagatttggacctttcttttctaagcagatatctactgctgtgctcaataaaaatataaaacaagccaaattttaaattttcaaagagctacattttagaaagtagaagaaaagaggtgaaattaattttaataatataatttatgtggcccaatgcatccaaaatattacctcaacatttcatcaaaataaataattgttggctgggcgcggtggctcacacttgtaatcccagcactttgggaggctgaggtgggtggatcacgaggtcaggagttcaagaccagcctggccaacatagtgaaatcccgtctctactaaaaatacaaaaaaaattagccgggcgtggtggtaggcacctatagtcccaactacttgggaggctgaggcaggagaatcccttgaacctgggaggtgaaggttgcagtgagccaagatcacgccactacactctagcctgggtgacagagcaagactctgtctcaaaaaaaaaaaaatttcgtttttgttttgttttgttttgtttgttttttgagacggagtttcgctctgtagcacaggctggagtgcagtggtgcgatctcagctcactacaacctctgcctctcgggttcaagcaattctcctgcctcagcctcctgagtagctgggactacaggcacgtgccaccatgcccagctaatttttgtatttagtagagacggggtttcaccttgttggccaggatggtctccatctcttgacctcatgatctgcccaccttggcctcccaaagtgttgggattacaggcatgagccaccaccatgcccggccaaaaaaaaattgttaatgagatatgttacattcttttttcatactatcttcaaattttaacttatggcatatctcaattccaactagtcacatttcaagtgctcaattgccagctatttgttaccctggttaaatagcacaggcctagattaaagctatgtctctgatggcattgattgactgaagccttagaaatggatgaggtcatctaggatggggttataaaatgagaagagagtcaaggtccaagtcctgagaagctctatcatttaaagcaggggtccccaacccccaggccatggaccagtacagcaggaggtgaggaacacgcgagcgagcaaagcttcatctgtatttacagttgctccccatcgcccacattactgcctgagctccatctcctgtcagatcagtggcagcattagattcttataggaccgcgaaccctattgtgaactgcacatatgtaggatcgggattgcgtgctccttgtgagaatctaatgccggatgatctgtcactgtctcccgttacccccgtatgggactgtctagttgcaggaaaacaagctcaggcctcctattgattctacattatggtgagttgtgtaattatttcattatgtattacaatgtaataaaaatagaaataaggtagttcacaataagtgtaatgcacttgaatcatcccaaaaccatttccccctcctcaccacctctgggtctgtggaaaaattgtcctccaagaaactggtccctggtgtcaaaaaggttggagaccactgatttaaagggtgaatagggaaagaattcctcctaaggcataatgataacattatttagtgctttgcagttataaatcatttccacatgcatttccattttttcttcccgtgaatactgtgaagaatagaaggttatccccattttttttttttttttttgagacggagttttgctcttgttgcccaggctggagcgcagtggcatgatctcggctcaccgcaatctctgcctcccaggttcaagcaattctcctgcctcagcctgctgagtagctaggattataggcacacgccaccacacccggctaatttttgtatttttactagagacggggtttctccatgttggtcaggctggtcttgaactcccgacctcagttgatctgcccgcctcggcctcccaaagtgctgggattacaggcatgagccatcgcacctggccatgcccattttatagataacaaaatcaaagccttagatgttctctcacccaaggcagagggggagctaaaactagaatccagttttctgatccaaagactaatgttctttccatttgtcttagtgagtttttccaaacagcacatcctattaacagaaattgcatgcaggatgtttattttgggaagtgattccaaggaaacaaggaagaagggaaagagagagttaggagcaaattaccacattgggccactgaggcttgatcctcccagggaccctctcaagagctgtggagagtgaactttagaattgtctgccctggggatttatcccctggttctcattatctgttggtcaagggttgctcccatctggtgttaagtccctgtcacttccaggtttgcacgtgtgtcagaggggtcatgtgggtaccacaggtgacaacttaggcagcaggagagaagctgctgggcagaaatagagagataaggagatactgctggggctggagtaaaaagttggccaagatgtaaaatggtcacaagaggtatctgaagtatcattgcacctcctgatttttgtggaggtgagggttcttcgtacaaataatttcaatataatagagatatattcatgcagagacagtgctatggaagcccagagaaagaagctgctaattgtgcctgtttacatggaggcttcacagagaaggtagccttggagctgagtcttaagtgctatggcttgaatgtttgatccctccaaaactcatgttgaaacttaatccccagtataatagtattaagaggcagggcctttaagaggtggtgggtcatgagggctctgacctcatgaatggattaatccattcatggataaatggattgagttatcacagggtgggttagttattattagagtaggtctgtattaaaagctagtttggctctcagtatgccccctttgccatgtgatgccctgtgccacctcgggactctgcagagagtccccaccagcaagaaggccctcctgagatgttgcctcttgaccttggacttcatagcttctagaactgtaagaaatacatttattttttaaataaattacccagtatcaagtattcagtgatagcaacagagaatggactaagacaaatggtaaggagttttctagaaagtgggataggacatgttccagacaaagattatatcatgtgttgaagagtgacagcttgaaatcatatgcaatccctggggaatcagcagctcagtatggttagattgttgaatatgggggcaggaaggagaggtggaagaggaggtccaagtctgagcttagtatttttggcttaaaagtgggcatctcatccattaaactgcagtggtgttcaagcttggatccatgttagaagcacctgaggagcttttcaaaaatatggctgggccccatctcaggtcaattaaatcatctttggaggttacagttaaataaaaatggttcaaaatattgtagatcaccgggcgtggtggctcactcctgtaatcccagcattttgggaggctgaggccggcagatcacttgaggtcaggagttcgacaccagcctggccaacatggtgaactgtctctactaaaaatacaaaaattagctgggcatgttgtcaggtacctgtaatcccagctactcgggaggctgaggcaggagaattgcttgaacccaggaggcagaggttgcagtgagctgagatcacgccactgtactccagcctgggcaacagagcgagactctgtctcaaaaaaaagaaaaaaaagcccagggactgatacgttctaaaatcttccatgtgattctaatgagtagttttgattgaagaccactgctttgaagggtttcatacaaggaagtgatgcccagatttgtgttcccaagattccttttggctggagagcagattagaggagagaccagttagcatgctcctgccatggtctaggcaaggcaggcgaggccagaattaaggcattgtctgtggggtaaggggaggggataatgtgaaagacacttgggttgaccagatctttgtgacaaaattcctttgaggaccttttaagattaagatggaacaggtaccttgggacggttaatgctgagagaaaactccgaatgcttctgtttaaagagggtggtggccacaagcctctgttggtgcaacttcatacatggaaagactttcagctgtcctgtactcacttcctctgatttgtcatccctgtcctcttgcagggatcattattctgcctgcctagagtacaacacaacatgggccatggactcacattgccttgggtttgaatcttcgctgtgctcttagggtcacaggagttaacctctctaagccttagtttctccacttgtatgatggaactgatgcttcttctcttgtaagattactgtgagaattcagtgggataaagtacatgcaaatatgagtccagagcagaaggcctggcccactgcagacactcagtgattgataactcatgtcttatcatttttgcagcttacctgccttagtgacaaattgacagttatctttattttattcccactgttccccatctgacttgcccttgtctagcccatttcaggtcagcccacccatgctgatgatccagtcttgtcatcttcctgcctgacctagtttgggttcagccctgctggggagatagtgccctcatgcctgggccacatgtggcataacacagcaagaactctttattgttctgaaatgtttacttgcccagctacctaaaaggttataagcacattgaggacagggaatggatttcatttgtctttgtttgcattttatttattcattgactccattcattcatttaacaaatagccattgaatatcaactctattgtaggccctggcatatattagtgagcaagatgggcaaatttattatacccttgttttgaacttatagtataatgagggagataatcattaatcaaataatcataaaataaatgttaaattacagccagcacaacatctgatttgggtagttgctccagagaagtttgctgactctgaatagagaaagcaccttgaacagataaaaccgttccctccttgtatgtgaagaacccaggaccaacctggtagccaggcagtgtcagtgagggaagcagacctctgcctcagagttctctagagatcctagttccccactcttaccctcagagccttctcagtttgaacctccagagtgcagggcctcagaagctacatgtgttagcaggcatcctggggtgttctcatgccactgaagtctgtgaaccactgcctgtgagacacaatgagaacttaaaaaaaaatagccttaatgaactgaagagtcattagctgtacccaagactccccctgggaaagtacctttgttctggtggacctaggtggggcggtagctttgacgtctgcttggttccccacttccttgtctactcgtaactgaacactggcagttagtggttgtcagatattcttttagcacaaacattccacattttggcacacactgagtctctgtcacacaagcaccagactgacccaatgccaaacaactagccttcattaaacgctgcctcttctgtgaatgcaggctcagggaccagaccactttgattttaatcccagatatgctactttctagccgagactttgggcaagaaattctctctatgcctccccttatatgtaaaatcaagatagtaacagtacctacttagaatatggttgtgagaattaaatggaataatacaagtgacttaattgtcagagcgatgagcacatcagaggtcctcaatggagactacctgctttaatgaagatatgtcctatggaaggcccttagctattagtgtattatggtcactgaaccagtactctgcaggatttccagcttctgttaaagggtaatgacctttcctcatgcatctgctttttcaaaatgaacaaaagtgctgttcttagataagcatttgtgattttatctttttatggagactttggaaagatttgctctgatttccaacctcgaatactcttggaaaatatctgtattatttttactctattggattttaatgtgtgttttagaaaacaacatctgcagatagatggtgttgcacaacaatgtgaatatccttaataccacaaaactgcacttaaaaatggttacaatggtaacttttatgttatgtgtgttttacagcaattaaaaaataagacaataacagaactgtggtttgtattaaagatctagtaactctaattaaagaaaaaggaaaggaagaaaatggtctctaaatgtttataggccctactagcatctctgtagctaatctggtttgtttatagagtactagagtcttactcaaaattataagctttgtttataaacccaagctcactgagacagactgatgaggctgctgaagttaccattaaagctacaggaacttttaagaaagtttttgaagacacactgtgtctgaagggaccatgaaaagttaatgatcatacttgcctgtgttaccagatgtcttagtctgttttgtgtggctgtaacagaatgtgacaaacttggtaatttataatataaagaacagaaattacttttctcacagttctggaggccaagaagcccaagatcaaggtgctggcaggcttggtgtctggtaagggcctggtctctgcttccaagatgatgccttgaactctgcatcctctggagggaggaatgctgttcctcacaatggcaaaagagtaggagatagcaaactcactccccaaaccccatttaattgtggcattaatccatttaagagggcagagtacttgaatacctaaatacctcccactagggctcacctcctgatgctgatgcattggtgatgaagttttcaacacatgagttttggaggggaaaacagtcaaaccacagcatctgtcttatgagctttttggggatggtgtaggacaactccagtggtactactttatattagacaatgaatattaacctcttttagggctggaaggaatttaggaaccatccagttccaaccccctcatttatccatttgattcaataatgatctgttgaattctttctctgtgcctaatgtatagtaggatataccatcgtggatgctgtatatactgtggtaaacaaagtagacctgccctcatgtagcttacaatctaataataaagatagatattaatcaaatagctgcataaatatgtaattacaccatgtggccagtaccgtctttagagggaaaatacaggcattctgatcaggagggtaggatctaaactcaggaggtcagagaaggctgagatgtcaagtgaagggctttctcggtaaaggccctggagcagaaaccatgagacctatgggcaactgcaagcaggccagttccaccagaggtgttttctgaatgagaagagggtgaaatattctacttctgtggagccaggaagcaggctgtctgatgctctagtttctctttctttctgcttctaaatagacttacccagaagcctggtactatgacatttgtgtaggtagaattgtttccatcctaaggagatatctgccccatatctatacggcctccagtctcagtgagcttagggtctgttgcgcctacatttccaggtcttcaccaaggcccctgcattggtgtttccatgaaccaagcaaggtcacttctactgttcctctttctggaccagcacttctatccatgcaacctagctcatgaagatcggttatgatcttcatgtgatcactgcactccagcctgggtgacagagcgagactccgtctcaaaaaaaaaaaaatttaaaaatttaatttatttttagactcatggggcacatgtgcatatttgtttcatgggtatattgcatgatgctgaggtttgggcttctaatgatcctgtcacccaagtagtgaacatagaacctgacaggtagtttttcaacctttgacctcctccccacctcccctcttttggaatccctagtgtttattgttcccgtctttgtgttcatgtgtacccaacgtttagcttccacttataagaatatgcagtatttggttttctgttcctgtgttaattcgcttagggtagtggcctccagctgcattcatgttgctgcaaaggacatgatttcattcttttttatggctgcatagtattccatggtgcatatgtaccacattttctttatacaattcatcattgatggacacctgggttgattctatgtctttgctattatgaatagtgctgtgataaatatacaagtgcaggtgtctttttggtggaataatttgttttcctttgggtatatacctagtaatgggattgctgggtcaaatggcaattctatttttagttctttgagaaatctctaaccttcttttcacagggctgaataaatttgcattcccaccaacagtgtgtaagcattctcttgtatgcacaatcttgccagcatctgttattttctgacttcttaatagccattctgactggtataagatggtatctcattgtggttttaacattcatctctctgatgaccagtgatgatgagcattttttcaaaagtgtattggccacttgtatgtcttctcttgagaagtgtctatttatgtctttgacccactttttgtgtgtttactctgtcactggttttttttgctgtgcagaagctctttagtttaattaggtcccaattgtcactttttgttttaactgcatttgcttttgaggacttagtcataaattctttcctgaggccaatgtctggaagggtatttcctaggtttcttttatgacttttatagtttgagggtcttacagttatgtgtttattctaccttgagttaatttttgtatattgtgagaggtaggggtgtagtttcatacttctacatatggttagccagttttccaaccaccatttattaaataggaagtccttttcccattgtttatttttgtcagctttgtcaaagatcagttggctgtaagtgtatggctttatttcagggtctctattctgttccattgatctatgtatctatttctgtaccagtaccatgctgttttagttatcatagctttgtggtttaaagttaggttatgtgatgcctctggctttatcctttttgcttaggattgccttggctatttgggctcttttttggtctgtatgaattttagagtagatttttttctaattctttgatttctttgggcaatacgacgcattcaaaaaagacttggaaggaaataaataaaaataaaagtgatatctaattagtagaatcttaaacatctttttttacttcattttataagtgatatttaagaaacttttagtactcttaaaatagaaaataatattgaaatgatcccgagggagtgtcagatctcttccttaccacctaaatcttactgctttctttaaaggatatactcatagggacttttggaaatatttaaatataagctacagagaaatgttgggtttctccactgccagactttgaggcattcactagctaatggacttttgagcccaggaggcagagagaacatgaacattctccagacttctgggaagctttatttactgaagcccctgtaggcctcgtactctctggaacatgcattggaaaatgctggtgtggtggaaagagaacaaaacgttgtggctacctgggctctgatggatgttgtaacaaagaaaggcaagctccccaaatgctcaaattgaactttcagtcaagctttatctgtctctcaagcagcaaacaatgccagttttttattctgcaagccattttagaagacaaaatgtttggcacagttgcacaggttagcatgctagtgtactgtgtacacaagatgaaatgtcttcaatttgtgttaaaatatgctttacccccttctcaaacacttgtcaaatgaaacgtagtaaaagtttttgtttctcaactacctcactgtgtaagtaaggccttagagaaaacaagctgacagaagcaagcctggttctttggctctatgggaagaatgactttcgtatcaacaatgttagaataaaatctgatcccagataaatgctgcttgctgcttctacctcaccagtttctgtcgtatgctgctgtggttggaacattttctggcaggaagaaatcaggggctctgttaggaaacaacagaattttctgccatgtgtaattcctgagcctctttctccactctgggaggtttctcaagggtccagtggccccagaccttagtcagtgttcctctctgcccacaatggccaccacctaagccatttcttggattcctttcactgcaagcctagctgcagaggagtctgtccagcttgcttccttgctgtgcccaaagccagcatacaggcccttttctttctaaaggcataatgctaattactggagggaatccccactgtgtgtaactaggaagagaacactgtggaggttatggcaggtcaagggtccttgcaaggtctgcacggtggtactccctggtctagtgaaatggagtagagtttgacactcaataggctctacttttagcttttcctagtggtccagggaggtctcttaaatcctatttcttgtcttcttttctccctggagtctcttagattcatagcagatgatatatatacccattgccacctacattttcaggtcttcactggggcccctacattggtgtctccatgaaccaaacaaggtcatttctactgttcctctttccagaccactgcttctgttcatgcaacctagcttatatatgtagggagattcacacacacacacacacacacacacaccacacacccacacacacccacacacacagctaaattaagcatttttaaagtggcagaccatactttgaggtctgcagcttaaataagcagccacgtgacaagcgtctccttcttctcttcctttcgcttccccatttacttccctctatgtttcttctctaaggaagatttaaaagcacatgtgccatcatgctcttctcccaagttcatatcagatgtcattaatcaatcatggaattttttaatcctgagtaagcccagagatataaccaaagatgactatcagttgatcaaaatgggcattgagcagtttactcctggatagatacccccaaagaaatgagagcttatttcaacaaaatgaaatgcatatgaatgtttctggcagctatatttccagtagccccaaactggaaataacccgaatgtccatcaacagttgaatggataaaaatatagtatatccatataatgaaatactttgcagtgatggaaaaagatgaactactgatacacacagtttgagttcatcttacatagtgtaaagtgaaagaagttagacataaaggaggcatactatgtgagttcatacattgcagttcaaaaacaggcagaactcatacatggtggtagaagttaagacagtggtaactgactgagaggggcactgggaagccttatgagggctagaatgtgttctgtatcttgatctgggtggtggttatatggatgtgcacatatgcaaaaatttattgaggtgtatgcctagtatttgcacactttactgtagctacccctcatttaatgtccttaaaagggggcaccaatttgaaaattattgcccagcccttgcttctatgtttctgtgtatagtttctgtttctagttctttctcctgctgtcatctgtccttcttctcctctgctgactttctttcctcctttttttcttcttttcatctccccctactcgtaaagctaaaaacatgaagtttaagtacatatattgtaaaatatattaaatacaattttacagttatattcataatttaaaagtgagtgtatttagtgtttttacacctctccttaaaacaaactctgcatttattgaactaaaattagatgaacatatttattacgtcttactggcattcaatggagtaactcagtggttcccaaacttatctgcacattagaatcatgtgggaccttataaaaattccaaagcccaggacacaataccacatcaattagatcacaatacctgggtctaggacacaagcatcagtagccattgaagctttccaggtgattcccgtatgattccaatgtgtagacaagtttggggactatagattaatggctttctattccttccatagtgtctcagctacttcagcatgtggttctgaatcttggctgcacattagaatcacctaagaagcttctaaacaatactgcttcttgggccctgttctgcataaggtctgaatatttctaacatgcaaacagcatgaagagccccgttctagcagggttgttgtcctggtagatcttgtgatcggagtgactccagtgccatcccctcaatgttcctctcaaatactttctcctcatgtttttgaaaattccagtcctttcttttgcaagcctaatatggagatgagtgatgtgatactgataagtttttggtctgtgttgctttcagtatgggattgtgctggatgcgggttcttctcacacaagtttatacatctataagtggccagcagaaaaggagaatgacacaggcgtggtgcatcaagtagaagaatgcagggttaaaggtaagatgaagaccaagggaaggggaggccaacagtggggcatgagaacatgagaggtgtatgaccagtagaacacaagagaaaaaggagtcccacgcataggaagccaagtgaagaaaacagtgcagctgctgttgttatgttatcgttacagaaaacatattgaaatcagtcgttaatgatcaaaacctaagaataaacacacataaatataattaatagtagctcccatcaacagaacacttctgcatgctatgtacttagtactgaacatgtgttacttcagtataccctcataatctccctttgaggtatgcattattatactaattttttaaaaatgagggcactgaggttgagagaggttataccacttgtttgttactcaagctagtaagtgatggagctgcggttcaaaccaagttctgcccgacttcaagtctgcatcttagccagtgcttctcaaacttgcatgagcttgttaaaaacacagatgatgggtcccatcccctagagtttctgagtcagcagatctggaatgaagcctgataatctgtatttctaagaagttcctaggtgatgctaatctgtctggttcagagatttattgctctcttaatctttgtaccctgatctacagcttggaagacatttttcaaagctttcagcttctgtgtaggcaggaaagaccaaattataggctcttagggctgggaaaaggaacttacagatcgtttaaattttgtttcacagagaaggaaacaaaaacctggaggattagtgccttgaaagtagcaacagaatagagacaagaatctaggtctcctaattacactctaggtttcctgctactctgagctgctgcattatatatcaataatttttttcttttaaggtcataatatgttagagtggttgacattcagctttcaatccctttacccagtaccctaccatgcaccattataccacagtctctctgacttttatctctcttagccttttgagctgggaacccactgtttatttttagtcagactgatagcctagatcctagaagataattgattttcagtttgacagcctgtggaatccactaattttcacaggtcgtcaagaaagtagtagagaggagatatttccaagagagcaagtcattctacccagtagccccatcaatactgacactttggccccatctgagacagtacttctggcctttcttaaagcccaaatccctcattttattggcttttatttgacacactgccttccatttttaaaagttattttaatggccaagcacggtggctcatgcctgtaatcccagcactttgggaggctgaggtgggcggatcacaaggtcaggagatggagaccatcctggctaacacggtgaaaccctgtatctactaaaaatacaaaaaaattagctaggcatggtggtgcgtgcctgtagtcccagctactagggtggctgaggcaggagaatcacttgaacccgggaggcggaggttgcagttagccgagatcgcgccactacactccagcctgggcgacagagcaagactccgtctcaaaaaaaaaaatctagcagatgtccttcttctgagacttatcccatgagcgtttggcctaacaatgaaggattcttccctctcaaaagagagagttctctagttaatcaaatatttaacaccaaattttctgaatcaaaacaattagctggtaacttagagctgattttctcatggttattaggctgtttgaaaacctgtgaatgatctggataacttatttgaataattatccttaaagcaattactctgctatgaagcactgatagtgtagatatttatcttaatgtgagatgaaagtgttgttataacttcaaaaagcttaaggaatcttggctctaatcctccatagcaacagtcggttttgctctaaaactggaaaaacagttttgctagggaggcaggatatcggagtggaaaagtcactgaagagacatagattctgttcctctttcttgtaacaggaagcaactccacctcagaaactttaaggtgctggccaggatcagataactagttagtggcagcttccatctttttagtaaaagccaatttgtctgacgcttaatttttattccaagtgttatctttaggtcttttaggaactagtgtcattaattacagtgttctggaggaaatatcaaaaagcagctaacagagtagctatctataatatccccattaaagtctgagaatgttatgcaattgaatatgaaattgcgccatccagtggcagaattattgaacactgaacagacccaacttaaagtctggaaattaaatcctctcaaggctaggtccagtgaattaccctctaagtacaataacctaatgtatagtacatcaggaaattgttttcttgtatttttttcaaaacaccatattttgatctactattgtcaaggtatgttttataatttttttttaaaagattgttatcttctacattttttcctaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggtatagcagcatgtagggaccaagagtatctgggagttaggcttggcagtgaaagagcctctgaagttatgggaaagggccacactccctaataccccaagttctacacacccaagtccatacttaagaaaggatattttagtaagtgaataaaatgttcaaactcttagtatatataggggtaggattttatgtatgttaaaaaaaaaagcccccttgtgcatctccctatgggggattcaaaggggaaggggcacagggagagaaagactgggcccgtatactctggggtttggggctacagatttaactattcaatatctgggaggaagaggataagaggagactcatagacatcccaggtcataaatattcacaactagcacatctttatatcacttgatacctgtgtgaattatttgttcacttgttcattcattcagcatatagtgcctgctctatccagaatatgaaaactcaaccctcaaggaaatcagtttcaatgcagggtgatcagtgttttaatagaggagtgctcagagctgctatgggagcacatttggccctgcccagggtgagaggaggtcaggaagacttagaggaagggatgcctgaactgaatcatgaaaaatgagttggaggatcggggaacagctttatcagcagaacagacagcatgcattcagtaactgatgtttattcagcacctattatatgtcaggcactgttctaagtactgaggatacaacagtgaacaggacaaagtctctgacttcatggagcttgtgttctaccggatgtgcaaaggtagggaagtgtgagaggcatattcagaggactgtaagtagttctgcatagatagaagataggtaagtagtgtaaaataataatgataataatagtagcagctcgtatttattgagcccgtcctatgttcttagcactacgctaagcacttaattgcactgtcataacaactctatgaaattaacaattattaacaagataaggaagctgtggcttacaaatgttaagtaactcacccaaggtcacacacctgggaagtggtggagccaggattctgagtgggattctgaaaaggaagggtccaggtcacaaagtgccctatggggccatgctaggaagtttggagtttatcttagagatagtaggaagccattaaaggatgctacacaactggtgacactggtagagaagatggattggaggggagaaaagctggggataaaaggaaggcagttagtaggtgtggacgccatttagatgagagatgacaggggcctaatgccagctggaaggtagcatcctctcgctcagagactcccagtgttgggtagcctagatcttggaagcaattgcatcccatcttcattaagacaaccctggaagattccttctttaggtctcaaggtctcaaacagacccaagaactgagctgtaatatgaggaagatttttcccagtctggcagcagaggagattggatatctattccaggtcatttgccacctggtttctactagaaccctaattaaaaacctggagcagagtctggccatgtaaccagctaggagccacccacagtggttaatatagcacacatcagcttcaggtatggtcatcaaaccatacccagctatcaccaccacagtaattttaagagcctttgataactttttgagccagggaacttcagaacaaaagtggtattttaaggaaaaccaacctatgaaaggattggaaggatgtggatttggagagagatgaacaaaatattaattctgcctcatccaaaaaaggggtttcttggacagctatgtgcgaagatccccatctcttcatttattccagggcattatggttcacttcttagtagcactgtgtggatgctgtagctgaaatgggtaatgtaatataattattaaaacaaaaatgataacctcagctcttcctttgtacaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcaggtgaatatctcacagcatccatggaggtggctctctggaggccaatgccattgctatctcaggcagtacttgggtcgctagccagaatgaatgaatgaatgatagatggatggatggatggatgactggatgaatgaatttactctcacatttgtaagggtcaccagaggtataattctcttacaagaccttctactattgggagaataaggacatgtctttaccttagggaggcataaaggaaattaaaaatttatcattaaaaattagaatagctaacatttgccttctgctatgtgtctcccgctgtgctcagcacttttcatgttttctctgattttatccttagaacaacactatgaggtactacatcatccccattttagagccccatatcgatgcctagagagggtaattagtctgcccatggctgtacagctaacaagcgactgagtgagaatttgaacttgaatgtgtctggcctcagacctcttgtttttaaacaccagttacactgcttctatgtccggcagtctgagctatgtctttgaagcccctcttttcttgctgataatctgttgtagatcaggagcctctagtgagctttgcctcacctttatgcccctgtttctttgccttaggaaatccctgactccaatagatactatgaaaagcagggtgtccagagacttctagcactggtaactgtactgtctttcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggcaagtataactcaatccagacctgcccccttcacatctgcacctccagcccccacatcctgttgttttctgtttcaaattcagtagtttgtctgaacttggttattgtactttccaaacctttttaggcaggatattgaactacatctggttgacccctataaattgtttcagtcagacatcccctcccatgtttgtttactgcgttatctccacagacacaactgagatcttctctcaggaaataatttctccccctcgtggggttgataatgaaaattatgtggtagaatattgtttgttggagggggaattgcaatttataagctcttttagaccactttttaaagctccctttcctacaaactacaaaaaaacagagttgttagaaatgacctggagaggagaaggaaaaaaaaaaaaacacttcaggagaaacacaaaatgtatcaattgacacttcaaatcttgtcatcttgtccccagatgccttctgcattttgaagacaagaaaagttaaacacactttgggaggctgaggtgggtggatcacttgaggtcaggagttggagaccagcctggccaacatggtgaaaccccatctctactaaaaatacaaaaaaagaaaaaaaattagctgggcatggtggcacatacctgtaatcccagctacttgggaggctgagaaaggagaatcacttgaactgggaggtggaggttgcagtgagccgagattgtgccactacactccagcctgggccacagagcgagactccatctcaaaaagaaaaaaaagaaaagaaaaagaaaaagaaaacaaaagttaaacatactcaacatcatgtgagtaccaggcacaccctgacaagcaaacacaaagccaggatgtcatatccagctgttccctgtctccactgaaaggataacaagttctctgctctcctccaaagcattctctctggttttcaaaaccactaccaataagatggtcctgggagtagggggcgctgagagacatccactgagcctcaaagctccactaaccttcttatccacagcagcctcctttcttccctagtaggttgtgggttagaaattacttttttttgggccaggcgtggtggctcacacctgtaatcccagcactttgggaggccgaggcgggtggatcacttgaggtccggagttcgagaccagcctgaccaacatggcgacaccccgtctctactaaaaatacaaaaaattagccgggtgtggtggcacacacctgtaattccagctactaaggagtctgaggcaggagaatcgcttgaacctgggaggctgaggttgcagtgagctgagattgcgccattttactccagcctgggcgacagagcaagactccatctcaaaaaaaaaaattatttttcttggataggagaatgcttgaagaagaaaaaaaatttttttaataatttttaaattatgtaggctcctggagaactactcccaggcccaaatttttgacaaccttgagagtttccttgtgaatttgctcctgacctagatgattaggactaagcactcagggacatttcaaactaatggcatttctgggcccagttttaactacatcagcattctttgactagccaaatacatttatatctgataccacttctggtgcctgttacacaaatccatttttcatatttattcctaagggtaaaaaggcagggcaggacatattgattccaataccaagtggtgggatgttgtacagtgcctacatattgattaagtcagactgtaccttttgtatccaaagcgttcacacatgatgctttcaagtgatttttccattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggtaagtttgtgaaatgatgaggtataggatgtcttgtttacaagttatagaatatgtgcctacaaaagatttaaataataggatgcatttttctcttacataatgtcttgaggtagatgattaggggttggttcttcagctcaactatgtcagaacttgggatcagttttttccactatcgttgtgatctttttgtgctaaggtatgttactgctccaagcaccatatcactaggtcactgcctcctttttggctctaggcagcaccttaagcccaggttcatctcctttctagtcaacaataagagtactgcctttccggaatgggggaggtcccaaagaggttagccccagcagtgtgggaaaactgactagggggttgtgcccaggggaccttgtgggacagacctcctacagccatagaacagccactctgatttggcatctcctttggccaagtgacagagcagacttcccagggctggggatgctaaatctgcctcttccttgtctctgcctgtccccagggatatctcccttcaggatgtcacgatgcttactgtgggttaagacaaagacaggtttcctgctagggaacccaggatgatggggaagctgattgtccaccttgatctcactttttccagtgtacaaattgtgagtttgggggaaattttccacaagcttggtgtcaggcagaatcgggggagaggtgacatggatgtggaagtttgattatcttcccgtctgcttggagttttttcacttctttgtggccccaggaactgtctcatcttcatatttgatttctgggatattgctggtgataatctcagtgctgtacatttgtttctggttgtctgtggttggggggcatgaagccagcttgcttccatgccgccattttggaatcagacatccaagcatcatattttctttcacatgcaaagccaaagcaggaaagatgtttaaggttttccttgcacacatctcttgcacacacattttgcagaagtgccaactgacatcttttcagatcctgctggccagaacttggtgaaatatatactctaaaccaatctgtgataaagagaaatggattaatatagttagtttagactaattattgtttatcacctgaggagtcgtttttgaggatattgctttcctctacttgggtaaaatcaggacttcataagcgaggaagaagggggctagctatggggtatgtgcctgttagagtttgccataggtggcttctcaaatgttagaaggaggaggagcagcagttagatgacacagctgagggttttcctctataaagacatttaggaagtagaaactcaggaaatcccaaagaaacattgaagataacatcattgtcattatgttttgaagagttgggggattatttgaatcctagctccaaattccttattttcttaataactccagaataagataaaatatttgagcagaggcagaagagatggctcttaattgactcagtcttcaaatttcttattttggtcccagaggctgagcattattataatcatagtttagtagcatattgaaaaattagctaccatctgtcaaatgccaattattgactatgcactatatgtatattatctcatttattcattcaagatattcaaagaaacaaggcttttgcctgccttcatgctttctcccttttcagaaaacagatcagcatgtaagaagggaggttcagctcctcccctccaggaccccagcaagagagtttctcctaaggtcacctggcttggcccaagacaaagctctagaagagaacataggcactgtcgtaatcagatctgattctacttctggcttcttatgaactgtatgagctcttcattttcttggtctctgagaaaacaataggtaatgccatagatccagacttaccttaaccatggtccaaaccacagtctaccctcccctcaaggttcctgagggaaatacatgacaagacaatgactggcagagtaatatttggttattagttggctgcaaacccaaattcagaagaaactgaacctcacttgaatgccctgtggctgagctggcactggctcttcaccttggacttttttttgggccagggcccttgccttagattgaactccttgaagaggaaggagggtgccaccttggccaagggcctttttcattccagtcactgcgaggatgtaaatctaaagtcaatgaacatacccttgtgtcttgagtttgtaacttctcagaaagtttcacttcctgggaaacatggccaattcctgccttcaagcttgagcaaacctttcctccttaggggactgaaatttcttgcctttgaatgtgattcatccaaccaaagcagggagagataggggctggaaaagggtggaggagtcttgaactccccctggaggcttttctatttgatcccttagttcctcattgagattgttctcccagccttctgaacctcagtttggcagttcctgagactatcgcattgcctgcctctatgtaggatctttctcctctagatacagccctcagggtcaggactgtcctgtcccgatttctgcattggcagtttcattctgcttcagatttttgatgttttttgttttgttttgttttatgccctctgtaatgtatccctaagacctaaagtttttttgtctgtttcctcatctgtacaatggggacagtaatatctacctcattgatagttgtgagtcagacaagcagtgatggtctgggaaatgtccaacaaccaactctcggggaatggggagctgatttgtagcacttaccagtttccatggtgtaagtagttctaccacagcctatttcaagctatatcaacatatcaactggctcacaaaaatctggaaattttaagaatcagctcttgtgagtacataagaaagagtcagctccagcacaccactgtaaatagcaaaaagcgggcataccccagcaccacccttaaaaaggttaggtctttatcctagcagtcttcattctatgctgtccttcctgcagggagttcctgttatcgagtcctgcctcttgaagcatagctatgtgcaacacagaaatccagtttcattcccattctttccagaactagttagcctgggtgttctcaagccacagagaatttgttggggagggagtttttgccacagttgcattcagcactgatgatctgattcttagttggtaaatatggtattaaaaattgtcattgctttagtcagtctggctacactgtagccttggttgctaaacagaatccaatgttgtgggcaaattagaaacactaacaagaaagagggaacatctgtagggaattacttatgaggtaatttagaaattatttttaaagatcacattgtgctgtttatataaataagaaagggaagaaacaagttcaataggaaactggaattaaagaacattaaaaacacatttgtttacatatgtatacataaatgtgtgtatatttatatttatatttatttatatttatatttttgttggtacaaaagtaattgtggtttcagaccatgaattttatttttttaattttttttgaaaagtactaaatatataaatattcacaagttcaacaaaggagagaaaataacaccaataaaatccccaaaaacttaacaatacattaatctaggttggatgatcttttttttttaattatactttaagttctagggtacatgtacacaacatgcaggtttgttagatatgtatacatacgccatgttggtgtgctgcacccattaactcgtcatttacattaggtatatctcctaatgctatccctcccccctccccccaccccacgacagtccccggtgtgtgatgttccccttcctgtgtccatgtgttctcattgttcaattcccacctatgagtgagaacatgcagtgtttgtttttttgtccctgcgatagtttgctgagaatgatggtttccagctccatccatgtccctgcaaaggacatgaactcatcattttttatggctgcatagtattccatggtgtatatgtgccacattttcttaatccagtctatcattgattgacatttgggttggttccaagtctttgctattgtgaatagtgccgcagtaaacatacgtgtgcatgtgtctttatagcagcatgatttataatcctttgggtatatacccagtaatgggatggctgggtcaaatggtatttctagttctagatccttgaggaatcgccacactgtcttccataatggttgaactagtttacagtcccaccaacagtgtaaaagtgttcctatttctccacatcctctccagcacctgtcgtttcctgactttttaatgattgccattctaactggtgtgagatggtatctcattgtggttttgatttgcatttctctgatggccagtgatgatgagcattttttcatgtatctgttggctgcaaaaatgtcttcttttgagaagtgtctattcaggtccttcgcccactttgtgatggggttgtttgtttttttcttgtaaatttgtttgagttcattttagattctggatattagccctttgtcagatgattaggttgcaaaaattttctcccattctgtaggttgcctgttcactctgatggtagtttcttttgctgtgcagaagctctttagtttaattagatcccatttgtcaattttggcttttgttgccattgcttttggtgtattagacatgaagtctttgcccatgcccatgtcctgaatagtattgcctaggttttcttctagggtttttatggttttgggtctaacatgtaagtctttaatccatcttgaattaatttttgtctaaggtgtaaggaagggatccagtttcagctttctacgtatggctagccagttttcccagcaccatttattaaatagggaatcctttccccattgtttgtttttgtcaggtttgtcaaagatcggatagttgtagatatgtggcattatttctgagggctctgttctgttccattggtctgtatctctgttttggtaccagtatcatgctgttttggttactgtagccttgtagtatagtttgaagtcaggtagcgtgatgccttcagctttgttcttttggcttaggattgacttggcaatgcaggctcttttttggttccatatgaactttaaagtatttttttccaattctgtgaagaaagttattggtagcttgatggggatggcattgaatctataaattaccttgggcagtatggccattttcatgacattgattcttcctacccatgagcatgaaatgttcttccatttgtttgtatcctcttttatttcattgagcagtggtttgtagttctccttgaagaggtccttcacatcccttgtaagttggactcccaggtattttattctctttgaagcaattgtgaatgggagttcactcataatttggctctctgtttgtctgttattggtgtataagaacgcttgtggtttttgcacattgattttgtatcctgagactttgctgaagttgtttatcagcttaaggagattttgggctgagatgatggggttttctagacatacaatcatgtcatctgcaaacagggacaatttgacttcctcttttcctaattgaatgccctttatttccttctcctgcctgattgccctggccagaacttccaacactatgttgaataggagtggtgagagagggtagccctgtcttgtgccagttttcaaagggaatgcttccagtttttgcccattcagtatgatattggctgtgggtttgtcatagatagctcttattattttgagatatgtcccatcattacctaatttattgagagtttttagcatgaagagttgttgaattttgtcaaaggccttttctgcatctattgagataatcatgtggcttttgtctttggttctgtttatatgctggattacgtttattgattttcgtatgttgatccagccttccatcccagggatgaagcccacttcatcatggtggataagctttttgatgtgctgctggattcggtttgccagtattttattgaggatttttgcatcaatgttcatcaaggatattggtctaaaattctctttttttgttgtgtctctgccaagctttggtatcaggatgatgctggcctcataaaatgagttagggcagattccctctttttctattgattggaatagtttcagaaggaatggtaccagcttctccttgtatctctggtagaattcggctgtgaatccatctggtcctggactttttttggttggtaagctattaattattgcctcaatttcagagcctgttattggtctattcagagattcaacttcttcctcgtttagtcttgggagggtgtgtgtgtcgaggaatttatctatttcttctagattttctagtttatttgcatagaggtgtttatagtattctctgatggtagtttgtatttctgtgggatcggtggtgatatcccctttaccattttttattgcatctgtttgattcttccctgttttcttctttattagtcttgctagcagtctatcaattttgttgatcttttcaaaaaaccagctcctggattcactgatttgttgaagggctttttgtgtctctatttccttcagttctgctgtgatcttagttatttcttgccttctgctagcttttgaatatgtttgctcttgcttctctagttcttttaattgtgatgttaggttgtcaattttagatctttcctgctttctcttgtgggcatttagtgccataaatttccctctacatactgctttgaatgtgtcccagagattctggtatgttgtgtctttgttctcgttggtttcaaagaacatctttatttctgccttcatttcgttacgtacccagtagtcattcaggagcaggttgttcagtttccatgtagttgagcagttttgtgtgagtttcttaatcctgagttctagtttgattgcactgtggtctgagagacagtttgttataatttctgttcttttacatttgctgaggagtgctttacttccaactatgtggtcaattttggaataagtgtggtgtggcgctgaaaagaatgtatattctgttgattaggggtggagagttctgtagatgtctatctattaggtccacttggtgcagagctgagttcaattcctggatatccttgttaactttctgtctcattgatctgtctaatgttgacagtggggtgttaaagtctcccattattattgtgtgggagtctaagtctctttgtgggtcactaaggacttgctttatgaatttgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttctatttgcttgatagatcttcctccatccctttatttaagcctatgtgtgtctctgcacacgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgtttttgcagtggctggtaccagttgttcctttccatgtttagtgcttccttcaggagctcttttagggcaggcctggtggtgacagaatctctcagtgtttgcttgtctgtaaagtattttatttctccttcacttatgaagcttaggttggctggacatgaaattctgggttgaaaattcttttctttaagaatgttgaatattggctaccactctcttctggcttatagagtttctgccaaaaggtctgctgttagtctgatgggcttccctttgtgggtaacccgacctttctctctggctgcccttaacattttttccttcatttcaactttggtgaatctgataattatgtgtcttggagttgctcttctcgaggagtatctttgtggcgttctctgtatttccttaatttgaatgttggcttgccttgctagattggggaagttctcctggataatatcccgcagagtgttttccaacttggttccattctccccgtcactttcaggtacaccaatcagacgtagatttggtcttttcacataatcccatatttctgggaggctttgtccgtttctctttattcttttttctctaaacttcccttctcacttcaattcattcatttcgctagaccattcttaaaagaagatatacaaatggccaacaaacatgaaaaaatgctcaacatcactaattatcagggaaatgcaaattaaaaccacagtgagacactaccttactctcctgcaagaatggtcataatttaaaaatcaaaaaataatagatgttggcatggatgtggtgtaaagggaacacttttgcactgctggtgggaatgtaaaccagtacaaccactatggaaaacagtatagagactccttaaggaactaaaagtagaactactgtttgatccagcaatcccactactggatatctacccagaggaaaataagtcattgtatgaaaaagacacttgcacacacatgttcacagcaacacaattcgcagttgcaaaaatatggaaccagtccaaatgcccatcaatcaacaagtggacaaagaaaatgtggtaaatatatatatgtatgcatatatatatatatatatatacacacacataaatgtatatacacacactatggaatactactcagccataaaaaggaatgaaatcatggcatttgcagcaaggacacatgatgtattaagtaaaacaaagcagtattataaaaaatttgtctagtatcatcatatttaggttatatatatacatatacacatatataattatataaatatgtattcactattttctattacatatctatttgctatagatattaaacagtaaattgttaaaaagtgtacatctctagaggatggttagattaaggagggacttccatttttaacttgtattatttaaattctatataataaacgtgtttttttttaataagccagcattttaaagacatttctattttgaaggaaaagaaatgaatagggaaacttcatgttttgagaaataaataagagcaagattctgagatgccagagggaggcttctgaaggtcatgggaaatttttcaagagccgatggcatgtagtgtcttggggggttggaggtggcatggaccaggaggccctgctgacttgatcgctatgtatcctactgaaggctcaatatgttgctaaatctacctcatagaaatttgttgtttgttgatctgttttttataatttgtacttactttataaagcaaatgtcactacttagcaaaagcaagagagtttctagatgcttacctcattgagacttttgctaatagaataagctctaggattaatttcagaaagtcttttgaaatgtaacaatttaaggaaatatttattagtgctttattacatgctcattataaaaaaactgtacaaaaagcttaaagtaaagactaaaaggtctcttctccctctcaccccaccatcagttcactagaggaaaaatgaggaatagttgtaataaacaggaagaacttttccaggcattagctatgcgaatccaagcatatataaatttatccagatttaacagagattgttgtgccttaggaactagagagagagcagttttctgccacttatttacggagcactcacatatgccaagtgccatgttagtgagggcagattcaaccaagaacaagggaaattccgcgcctgccatcacagagttggcattctagaaagcaggcagacatgagaccagaaacacaaacaaaggcaaatccgactgctgcaaatcaaaaggaactgctggggcaggtcgcggtggcttacgcctgtaatcccagcactttgggaggccgacgcgggcggatcacgaggttaggagattgagaccatcctggctaatgcggtgaaaccccgtctctactaaaaatacaaattagccgggcgtggtggcaggcgcctgtaatcccagctactcgggaggctgaggcaggagaatggcgtgaacccggacgcagagcttgcagtgagccgagatcgcgccactgcactccagcctgggcgacagagcaagactccatctcaaaaaaaaaaaaaaaagtaactgctgggaggaaagagacagtcctgtgaaagcagataacagagggtcctagagacccctctaaggaggggaagtggaagtccagggaattccagcagagggaatagcaagtgtacaggttctaggggaggaaaggcttggcggggattgaaagccagggtgctgggtatggtgggcatgggggcagggctagaacatgcctggttttcagcgaccttgtaggatttgatttttattctaagtataattaggagccaccaaaggttttaagcaggggagtgatatgatcagatttgtttttaaaagattcctgtgactgctgtttgtaggatgggttggactagaaccagaaagctaatgtggagactaattaagaggccattgcagtatccacacgagatgatagtggcttgggttaagagggcagaaataggaccataccacgatctttttctgcacctgggatacaatgataatggaagtgctggaattcctgagttcagggcatatggaggctctccagtttctgcagagctcgacttcctagaggaatgagcataccagttcagaggctaaatgtatttataccattgctcataggggaaattgctggaaatcaggagaatatctaccagtagagagttgttgaataaattaagatacatctacaccgtagactcttatgtggccattagagtggccccagctgacttggagggatttctataaaggattgttaagaaaagcaagatgaagaatctgtttaaaatttcatttctaaaacaaaccctttatatgtgtgtgtttgtatatgattataggagcatgggaaaaatggaaggcttcatattaagttgttagtatgaactcctgttgggactgaaagtggaagaaaaaaatcaagccaaaaaaaggaaaatttattaaaaaggactaatatgctcacacttatgttattagatatatatgtataagaatattgaaaaatgcaacttttaagaagctggcactgggtttatgtcaattggaactgaggcatacggcctgtttgcagcaggaaattgcctggtggaggatatttttcctcatctctgagtcacagtgagcccccaatgggatctctgctacctcctgtttctttgcctaccaaaactctgtttctttgcctatgcgaattacactttgggaatcacatttgctttctacattcacttctagttaagtaattttacagaaggcaaattataatccccaatctaaccgtgtttgccacagggaaaactttatgcccccctcaaataatctcagtaaactatgactcagcacagtgtctagcaaacagagctcagtgtgtttgctgaatgaacaaatgatgtgctcctttaatatccaacatgatttccccctaaaaactggcacctttttgggtaggaaagaggaaaagcactggagttggggtttgaattgcctcatctagcaagctctgctcaattattttttcccctttaaattatgctctattaaaagagtaaaaaggcagttatagggtggtatgaagtataataaacattttatatgtatcatagaatgagaaagatgctagaagcctatatactatattgaatagcagttgtcactaagtagtagaatttagaggtcattttaatagaatttttttttgttttactgatttgaacttttaactttttttatagttcttatgtttgatgatgataatgatttttaaaaaatttcagttgtgtctaaaatagtacctagcccatagtagacctgtaataaatatttgttgaataaagatggattttttaaaggaaagcagtacatattcattatagaaaataggcaaaaaataagcacaaggggaaaaaaccaatttcgctactcagagataactcaatagtgttgtatagaattttccagttgtttatatttattaaacattcatatgtagtacatagtatttttaaatgggatttttgcaacccctttctctctcttttcttattctctttccccatttttctttctccctgactcttctattacaattatggagaaaagtaactgccaggtggcttagaaatgtgtgtcagcagcaaagtggctcctcttccaggaaggaaacagctcttgggcctgcaatatcactttgtgtgttaatttactcagcagaactttccaggcacctgcacaagggatgcggcctttaggagagcaagttggcatccctctgtgtggaacacagcctaaaactgcgattttctcttgtaggcattttcagctttttactttgtgatgaagtttttaaacttgacatcagagaaagtctctcaggaaaaggtgactgagatgatgaaaaagttctgtgctcagccttgggaggaggtaagtgactaggcacagcagctctaacagcatgagtgccctgtgtcgttgctgatgcagaggatgtgagtctgctctgaaactcctgctggtttgaccaagatccagcaaatgtgttagagaagaccagatggtggactcaggaatgaatttatcagcattccttgataacttgacatccagtggcttaaataagatcttatttttttctcacctaatacaaagtctggcagtaggcagctgctggcatggggtcagcagctctgctctatctcagccattgcttcttcagctctgctgttgtgcctgtttcttcatggacacaagatggtggctgtggcttcaggcatcacagccatgttcagaaaggtcagaaaaggggtcgaaccagatacatctgttcctttttacaggaaagcaaaagctatcccagactcagcagtcttccccttatatctcaatggccaggattgactgggaaaaccaggtgcagaattttgtgaccagcttagagcttagacctataatgagccactgcctcgagctgggcacattgtggcccactctcctccttcagtccccaaatcagagttctgttagcaagaaagcaggcaatttgcagagtctgacacagacacaattgtggtaaaatcctctccatttcccaggtccaagatatctcctacttattcataaacttgaagcacaatttttttcttatcagaggcactgagccattcaacatccagtgccacaagatgaaaatccagggatgagaggtatggaatccactccgattataaaagacatagctcaaaacagcagctgtacttaagttgacagttgcaaaagtgaatggtgttttcattcttaagaaatactattaattaaaaatagatgcttatccctgactgcactgacaagggggaagaaaggctgagcaagagcctggaagcttgccattctctccaggtattttgtctagaacatgaaagaaatgtggtcagggccttcatcaagagttgctcaaatatgtctcagcattttacaaaatgcttagcggtggttttttgcatctggcggtgatctgtggaggaagataagcatgttagagtggaggcaatttgagaccaggcctacatgtggctgctgaggaagcagatttaggctgctctttgaaaaaaaattacttctggtttagattaaaagttctcatcctggctaacatggtgaaaccccgtctctactaaaaatacaaaaaaaattagccgggcatggtggtgggcacctgtagtcccagctacttgggaggctgaagcaggagaatggcatgaacccaggaggcggagcttgcagtgagctgagattgtgccactgcactccagcctgggtgacagagcaggactccatctcaaaaattaaaaaaaaaaaaaaagttctgtcaggtttcctctcttatccacatctcatgttttacttcataagactatgttaggctgggaatgcttatatttagacctgtagttctgctcaggtaagtcatgtggggagttgttcagaggccctggaagtaagctaagaagggcctgcatttgggagaattcctgaagcatttggggaaggggttgcagggttagacccctgtcttcacccagagcctacagcattgaggtggatgttatgacccagggttcactttcccaagctgcatcgtccacccaggtagaaagcatagttttgtcaagtacattgttagaaggtgactctttcttctttccctcctaacttcatcatggactgctactccagtatggcttgtgtttgggaatgttcctcctaaacacctttggtagagagataattaacaatgtttaagcatgtactatgtgttgacagtggtggacatttgcttgctgtgctttatgcatatcctatcatgctgccttcccctgctttggcaagggaaataaaatgcaaaccacacctgctgacactcagtcaggtacctgaagccattgggtctctgaagtggagggaccaggagagtgagtggaagggagactccatggttgtcttctggcagcttcattagagggctagtagaatctttcagcagccagaacacagccaattttctactctgaaaatctggtcatccaagatctggtcagcccaagtgaacaatgtgatcagattctatgtgtactgatgaccagttatatttcagtgtactctggatcctcacattcagcctcatgaatatttagcctttctagggaaaggcatcccattcttgaagatccatcaatgcccctttatgtggagggcagaaagaggatatccatgaagagaaaagaacctcatcatgttccactgccctgggaatagaaaggagagaagagagaggggaaggtgggagagagaggagagaggagagtagacttcccctcccaatttggagagcacatagtgatccacccacaggcatgagcatgatcaattctggattgatgaagaaggtggatgcctttttggcttctatatttttggctactatcataaccttcaggaggccagactgcatagccaatgtacagatttccagaaggaggaggggaataggagtattaaagaattcagggaaattaggccaaaatggcatctcccagccccccacaagggataggccagccttcaaggacctacaggggctcagcactttcaagttggacctaagtagattcttgggattttgtgtcccataggcatccttcaattgacaggcccaagactacttcaataggggaggaggtcttttcacaaagggaaagcagaatgcagtgactgaaaggaaggggtaggaacctggacaggcaatgccaactgatgtccacaccaaggtctcaagaggatgtcacatgcagaggaatcaatcaaaggataatttccagaactgtgctgaaaagacaagctccaagctgggtcattctgagaatttcatcagagcaagacaaggcagtctagttatggacttatccttccagaaactggggacaggcaagaaccaagtgagaaacagaccccagccagcggttaggatttgcatatgggttaggacccacggaagggagagaaatctgggaaaagaggggtgtggtttaggcatcaaggagatactacatataaaacatctggcatagttccagatggtacatgatgcatgcataacaaatgttctctctctgccgagggtatccaggagggaatgcctatctgaagggctgaggaatggggcagcagacagaagtccaggctgaactagagaggtcctggcctgttgtcctcaaattgagggcaggagagttgcagagcaggctgtgggtatctgggtgtatattcacaacagctaggctaggtaagggcaagggatggcaagcagctcttaatatttttagtagggagtaggatgagtaaacataggaaggactcaaggaaacaaccactttgcatgactcagatgcaaaaaaagacattaagacagaagatagaaggtgagatgttggcagtgctagcagtcctcagcaaaatgctgcctaaactgtgtccacagctgtgtttctcaaactttactgtgcacgtgaatcacctgggaatcatattgggatgcagattctgaattggtagttttaaggtgaggactaaccagctcccaagtgatgctgatgctgccagtccagggactaaagtgagtggtaaggctttttatggctgtgggccaaaggctctggtcaagagcatatagaaaactcagattaaacaaagtctagggcatgaacagaggtactgaaatttagtgtttcagaacctactagaccacaggaactacttttttcctggaggacctgttattatctcatagaagcctgtgcaggaaaagcttccttaagagaccctaaactataaaaccctgctcccactgaaggagtgcagcaccacccccaaaaccctctggaagaggccaaccttcaggtgcactggagctggggctttcccctctcttcatcagggctagtagagaaaaagagggccacagagaggtgcctatcatacgagtatgatctccccctcacttcacttctagataaaaacatcttacgctggagtaaaggagaagtacctgagtgaatactgcttttctggtacctacattctctccctccttctgcaaggctatcatttcacagctgattcctgggagcacatccatttcattggcaaggtaatttgggggcctgttgggctggggggaggttggggttcggtggtagtgactgaagcagtttggggcttgaaaaaggggggagtcagcatggtgtagctttggcttgatgtcctgttctgccattctgcttcaaaccctggcattctgtgtcaagccctcctgggtctgttggcccactgtgagcatcctcgctaaggacagctacttgcattttcagttgcaccttcccacataacagtgactaattccttacaaaacaaaacacaaaacgagatatattaaagtaacagcatttcagcagctacagtgactctgtgtgctgacttcagcagccctctgaaaggccccttccataagctgggaaagtatgatcatggtttcatcatccttgttggttattacttcaaggttgaccaatctgaaagctctgtgtgaagaaggggactgagtggctgtgaatgatgagaccgttgtttagaagccaggcttagcctgagtccggaagaagcaacctcaatgctgtgctttaccatagcaccacctgcaggtatccaggaatagagaacccagctgagcgactcatgcttgaccaaaaatacccagagcagtgtgtctctacctttttaagcccatgctcactagtggggaaaacattttaccccctgtattaaatatggtgatttcaagcaaaacaaagcattgagacagagggctgtagcaggcctgaggataacagtgtccttacactcttgtcagtgctgatcttgctaattcaaacttaaatcttttccttgttataatattccagacttcctttaattccagcagtttattttgtttgaaagattatacctatgtcaaatttaggactgacacacgaggtagtcatgatgtatgtgtgtgtatatactttttttttaagagacatggtctcacgctgtcacccaggctggagtgcagtggtatgatcacagctcactgaagcctcaaactcctgggattaaatgatcctccccacccaggctcccaaatagctgagactacagacatgttccaccgtgcccagctaattttattttttagagagacagggtctcactatgttgcccaggctagtctcaaactcctggcctcaagtgatcctccctccttggcctcccaaagtgctgagattacaggcatgagccactgtgcccagccagtgatttatattgtttgaactcttccaatgcatgatccaataattctaagccctaggtgataactcttctaactcctccaaccacaaacagactttccccactgtttgcagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacatggcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggagaaaaaagatcagcagaagtcattacttttttttttttttttttttttttttgagagagagtctcactccattgcccaggctggagtgcagtggtgctatctcggctcactgcaacctccgcctcctgggttcaagcaattctcctgcctcagcctcccgagtagctgggattgcaggtgcccaccaccacacccggctaatttttgtatttttagtaaagacagggtttcaccatgttggccaggctggtctccaactcccaatctcaggtgatcctattgcctcgggctcccaaagtgctgggattacaggagtgagccaccatgcctggccagaagtggttacttctgtagacaaaagaataatgctacttaatcaggctttctgtgtgacaagaaagagaaagaaaataaagaagtttcaattcatccaattcttaataagaaatatgtaaataaaattttttaaaattacacttcattttaatgttgtatcagtcaaggtccctgcaagagatggatggtatggtacactcaaactgggtaacacaggagagttttcagaaagcaactaaatccaaaatactatcaaggaatcaatataaaaattgttaatatttttctcatactaaattttcaaaatattttgtgtctattacatttacagcacatcttaattaggactagctgtgtgttcacctcacatgtggcttgtagctaccatactggacagcacatgtccaaaaaaatacacgtaaagttaaagtttaaaagacacaggaactaagccctcattgtctttcccttgggaggtagtttaaagagctatagatgctgtaacattcttgctattatttattatatatgacattattcctaaaaaagcttttgagatcctaggttgtattcctcaggttttgttgccttcccatgaagatgtgaaggcagggatgcctgttattcagtccaagatgcatgacaagagaccttgggaaagtttcatctggatttaaagattaattcttgatgcttacattccatactcaaaatgtaaatttgaatattaaaataaagatgattttttttttggagctagtcttgctctgttgcccaggctggaatgcagtggcatgatcatggctcactgcagcctcgacctcccaagctcaagcaaggctacaggtgtgcacctaagtagctaggactacaggtgtgcaccaccatgtctagctatttttttttctgtagagacagggttttcctatgttgtccaggctggtctcgaactcctgccctcaagcaatcctcctgccttggcctcccaaagtgttgagattacaggcgtaagccactgcacctggccaagatgaatattttaatagctcacagaacaaagtttgccacataatgataaaattactatgaaaatatattccctttattgtcagtttaaaagatgaactgagtttcacccaaactggtctggcccctctctgattcaaataccaatagttgctctgattcaaattccaactgttagaacatgacagctgctcataactagctttgcttactaaccatgtttctttccatttgtattaggtcctttactttttataacagcctcaaagtttcatgaattgctgcagtaaacattgattttcatgtttgtgagtctgcaagccagctgggcagctctacttcaggtggtaagggtggatcagacctattccatatacctcttgttctccttgtccagtggtttctagggatatgttctcatgatgaaccccgcagaggctcgtgaaagtgagaggaaactaggatgcctcttaaggtcttggtcaggatggggtctcctgtcacttctgtcacaggctattgtaagtcatatgagcaagctcaataaaatataaacaagtcagataaacagtgggaggaatggcaaagtcatatggccaaggccatgagtgattaattttaacacaggaaaaaagtaaagcattaaatgcgattatttaatatacaatgtcttattaactgaaatataaaatgtgtttactgtaaaatataatctgtttatctcaccaaagaaatattatctttaaaaaatgtcattacttctaagacatcatcagtctgcaacttctttccatagccttaatcaggatgctgtggcagctcccacattagcctcgcattctaaactggtagatgtcctaggaaaccatacatctatgtatttttcttattttatacgtttaggacaatgtatagctaattacccaactttttatttgcatacaaatctaatacaactgaacacaatcagttttatcacaggtataatggatttttcaatagtgaggaggtgcctccatgagccttctctttagaaaagtggcattcaagactcttcatttgaagtgaagattgctatgtcttttgcattgctctattttacataaattaagttataaattgacactataatcaactgacaccatgatcagtgatgatgatcaccctcatcagcactagagttgacttgtttttataacccctttgcatgtatgttgaatagcaaagttcatcagagaacatgtattagtcaatggtaagtaagatactctcatctaagaaataacatcacctcttctaatgaagttctaagaagagagggaagaaaaagtcttgggagctagtcagggaatagtgtgtatttgcaattacctaaactgaactctaccattactcctaacccagttcctcctcctgtgttttacatgattaatgccacccctgcctcaatgaaccaagatcagctccatcactgggacctccccattctgcctgtgcaatatttttcttttttatttctccttctaatattactgttattgctccagtaaagagctgtaatatattttacctggactgataccaggaatggtggtgttgcttccaatctgttgctgctagattaatctttgcaaagcacaggcttaatttcattgctgctcaactaaaaccactggtggctttccattgcctacaaaataaagtcaacctccccatcagacattcaaggctttcaatgatccatggccgccagctctctccaggctcatatcccactccactcctctgatgtttcctacactacactacactatactacactacagccaggtagaatgactgttcacccaacaccactcaggttgtcttctcaacttggaatactcttgcaccttcaaagctcatttcaaatgccccttcatttgtgaagccttctccaaatttccaagtcagaatgtctcttccttgtgctaccacaaccctttaactgagcctccattagtgcactgagaccattctgttcagtgtctgggtgaagcttcctggtgaaaaatatgttacctatttctttctgaaaagttggattcagggatattatcacggacctaaggtaatagttctagccaacctccctgtccactgccaggccgactacaaacccttctgttgctggcgagctggtccgcaccactagttctgcttcactctatttatctcttgatgtaaccatcttctttctccaggttttaagaaccagcccaactcctggttccctgatgaagcttttattcccctagccacatggaacttttcctttttggaacatgcctttagtttctgtgtagtttgccatgcagcacttcattgtacacattattaaaacagaattttaaggattagaatgaaccttaaaagatcatgcatctcaaaatttaatgtacatacaaattacccagggattttgttgaaataaaaattatttaattttaattaatataaataattcagtaggtctggggtgaggcctgaggttttacatttccaacaagctgccaggtaaagccaatacatctgtccaggaatcacactttgcgtatcaaaggtctagatgacattatcattccaaagagtttcttttacaggctctcagatcagtgttcatccactacctgactactgtcattcacaggcattctgttccacagcaggccagctaacgtggtatttacaaagctcactcctcttatacaacaatccaagtgtttcttttgtcagttgtctgtgccccaggagatccctctctgccttgccttgccctctgcctttggagaccagcacctcatactcagtgaaggcctggagtgcttaagagggatttcttccagctctcttgccctggtcttcagtgtattagatgtattacctccatgctctcagtagaggcccataggaaagagtaggtaggttatgccagctcacacgcatcctttaaaaatggtttagaagtttagctggtttcttattactcctgtctatggatgtttccttctgtcactctactagggatgaaacagctaatcatgttcaatagttacatttagattggtttttaaaaactatgattgtattagttcgtttccatgctgctgataaagacatatctgagactggaaacaaaaagggtttaattggacttacagttccacatggctggggaggcctcaaaatcaggtgggaggcaaaaggtacttcttacgtggtggcatcaagagcaaaatgaggaagaagcaaaagcagaaactcttcataaacccaccagatcttgtgggacttattatcacgagaatagcacagaaaagactggcctccatgattcaattacctcccactgcgtccctcccacaacatgtgggaattctgggagatacaattcaagttgagatttgggtggggacacagccaaaccatatcattcctccctgggctcctccaaatttcataatcctcacatttcaaaaccaatcattccttcccaacagttccccaaagtcttaactcatttcagcattaacccaaaagtccacagtccaaagtctcatctgagacaaggcaagtcccttccacttacaagcctgtaaaagcaagctagttacctcctagatacaatggggggtacaggtattgggtaaatacagctgttccaaatgagagaaattggccaaaacaaaggggttacagggtccatgcaagtctgaaatccagtggggcagtcaaattttaaagctccataatgatctcctttgactccatgtctcacattcaggtcatgctgatgcaagagataggttcccatggtcttgtgcagctccgcccctgtggctttgcagagtacagcctccctcctggctgctttctcaggctgatgttgagtgtctgtagcttttccaggcacaagatgcaagttggtggttgatctaccattctggggtctaccattctggggtctaccgttctgggactgtggccttcttctcacagctccactaggcagtgccccaacagggactctgtgtgggggctctgccccacatttcccttccacactgccctaggagaggttccccatgagggctctgcccctgcagcaaacttttgcctggacatccaggtgtttccatatatattctgaaatctaggcagaggttcccaaatctcaattcttgacatctctgcacccacaggctcaacatcacatggaagctgccaatgcttggggcctctaccctctgaagccacagcccaagctctatgttggctcctttcagccatggctggagcagctgggacacagggcaccaagtccctaggctgcacacagcacagagaccctgggcccagcccacaaaaccactttttcctcctgggcctctgggcctgtgatgggaggggctgccatgaaggtctctgacatgacctggagacattttccccatggtcttggggattaacattaggctccttgctgcttatgcaaatttctgcagccagcttgaatttctccttaaaaaaaatgggtttttcttttctactgcatcatcaggctgcagattttccacatttatgctcttgtttcccttttaaaacagaatgtttttaacagcacccaagtcaccttttgaatgctttgctgcttagaaatttattccaccagataccctaagtcatctctctcaagctctaagttccacaaatctctagggcaagggtgaaatgctgccagtctccttgctaaaacataacaagggtcacctttacttcagttcccaacaaggtcttcatctccatctgagaccacctcagcctggaccttattgttcatatcactatcagtatttttgtcaatgccattcacagtctctaggaggttccaaactttcctacattttcctatcttcttctgagccctccagattatttcaacacccagttccaaagttgcttccacattttcgggtatcttttcagcaatgccccactctactggtactattagtccattttcatgctgctgataaagacatacctgagactgggaacaaaaagaggtttaattggacttatagttccacctggctggggaggcctcagaatcatggcaggaggtgaaaggcatttcttacacggcagcagcaagagaaaaatgaagaagcagcaaaagcagaaacccctgataaaaccatcagatctcgtgagacttattcactatcacaagaatagcatgggaaagaccagcccccttgattcaattacctccccctgggtcctgtgggaattctggaaggtacaattcaagttgagatttgggtggggacacagccaaaccatatcaatgattttgtactttaaccagctgaatggaagtacaatctcttgctatatgacacaataattatttgcaaaatgagtaaacatatcataaggaaattatttttacaaggtttgaaacctgaaatgcagtctattatcatacataactaaaaatagagcctcaataaacagattcccagttttgaaaatgcaacatttgtactccacattgtcagttttcttaggtatatttataaatactcctataaaaatgtaaagaaacacataatgtagattgctaattttataataacacaagttgattttgacatccaacttattaattatgaaatgacttttggcctagtaacaatgaaaatgggggcaaatacagataaatggtaattcttagaatgaactactcagcaccaattctaagtttttcttgatggtaaatcataatgttccctttctcctcggttctgcaatctataggcataccataattgtaatcaatagcttaaaaatatgtctctctgtcctattctgtatctgtatctcttggatttttacctttgcaatagtcaactgaaccatcttcttggagtactcatgaagatggaagtctacatggagaatacaggatgaatccactctgtctcctgcagtgaagtctgtttgaaggatgtatttggctgtcttctggacaggccattctaataacagaaacaaacaagttattttaaaacttattggaatattcaaatattaaccaaagtagaaaaatataatacacatccatgtgcccatcacagaacttcactgattatcatcatttagccagtcttgaagaagcaagtgctaattacaatcacaaatgaaacaagattcagacttcatgaagagcactgcgctataataaaagaagaaatgagcacatacattcttttactgacagtcaaatggtgaaggtgggcagaatcattatgtgatgcaacatggcaaaagtatacagacagtgcatccagaggaaggcaccttgctgaatgactagaatggaagtaggagacattttgcaggcccccttcatcctgcagggagaaccagaaccacagcagctctatttgcctattcctctttaaattacaaagttaaaatttgggagtagtagaaaatcaattggttatcttatagagtctcctagaatatttcattggcattgagaaggtggaaaatgcaaattatatactttaaaatgtaatttttgcttttcacatatgcttaaagcctaaaacctcttaataaacttcttctgaaatatacatttgtgggacaattctagtatgttttaaatgtaactgtttcatagtgtttatagagaactctatttttttccaactgcaatcccttcttaacccaaatttataacatgctgtattgtatggatctgtcagtagtgggtcagttaaaaggaagagggtaggaggaatcctgtctggctgtcatctgccttattttttcttaggccaaggctttttaggataactaaatttttcctttaggtttctccacttgattggaatacctttgagtcattttaatcctgtctgtagtagatgaagaaattagggaagtatgaaaaacttggtaatttgaaacaaaaacttgaatctgattttaatagagtagcttagttcaacatggaatatccatttatattgaaactcattctttcatatagtgtacttgtaaccccgaccccatatctggtactgagtgacaagagggaagaaaaaggaaggcttttgagaaaaggcctttttatatgctctctttggaatactataaaattcctaacccaacccaccatcagtaatagagaggttttcctaagagaagcaaggaatttttattgaccagcattgtcttttatcttgtacaatggaagacagtgggttggagttagggtgtagaattataattatggaatagagctatattatcataagggaaatgaaacaatttctggtttaactggtaccaactgctagctactggaaacctaggtacagataaactgatcagttttgcaaccccaagccatgaaggagaagtgacagtcatttcaagaggtcctggccaacctctgtagaggttgtatctaaaccctgaatatgtgtgaattcatgaaacacttattttctaacatgtttacatatcaatgggagtgattagggatagggttgagaaagattatcccatagctaaatcaatatttacctctgacttctacctctgcaattattggtaccaagattcctgtcaagtgaagaaggtgaggaagatagatgagatattagtagaaaagttatgagagaaaaactgagtagtctctaaagaaataccaaaataacccacactaggttcaggcaggagttaacatctaaccaggtatatacagaataatgtcatagataactggagaaaatatattgtaaatcggggaaaggcacataatgactttctctatacacctctttgtgtcccttcaaccttttctctcttctgtggccttattttctattccagtttttctattccagcacttctcttttcctgacttttcttttgatttctatacctttttatatccttccttctcttgttctttccctttagggtgccatgctttacttttctccttgccttgcacttcaatttctgagggcagtgatctgctaatgctctcacctcagtgatacagatttaaaaactactgaatgatagaagaaaggactactgggttgtgtatgtcaaaaatattttttgtagcacatctataaggaatatttttaagacccttgtctaaaaatcatggcctttacatttatgtttctgattttttttttttttttttttttttgagatggagtctctcactctgttacccaggccggagtgcagtggcgcaatcttggctcactgcaacttctgcctcccgggttcaagtgactctcctgcctcagcctcccaagtagctgggattacgggcgcctgccaccacgcccagctaacttttgtatttttagtagagacagagttttgcattgttggccaggctggtctcaaacttctgacctcaggtgatccacccgccttggccttccaaagtgctgggattacagatgtgagccactgcacctggcctgtttctgatattctttatggtcaagaattaaactatttaaatgtaagttatatttacttcaatcctaagaaataacttaatggggtattttcaattcatagcaatcagaaataacctcggttgtaaattgaatctatagcgcaacaaatattgagtgataattttataccacttttgaatgtttatacaaatgccctaatttgaaagaagtttgagtgtttcattgaaataaaataccattccttagtgtagagaacaaaatgactgacttgtttaaataccaatcaggatttatgttaacaggaagtgggtggtcctgaaaagatcttggtctttgtaagaatgtttcttggggctgggcgtggtggctcacgcctgtaatcccagcactttgggaggccgaggtgggcggatcacgagatcaggagatccgagaccatcctggctaacatggtgaaacccagtctctactaaaaatacaaaaaattagccgggcgtggtggcgggtgcctgtagtcccagctactcaggaggctgaggcaggagaatggcgtgaacccgggaagtggagtttgcagtgagccgagatagcgccactgcagtctggcctgggcaaaagaacgagactctgtctcaaaaaaaaaaaaaaaaaaaaaaagaatgtttcttggtcaaagtccaagtcttctgatggcatttattcttgtggctcactaggtgggtggtaatagtaaaatatttgccttggtccagttccattgttgaaaacaaaatttcttaactccatttgtttttgaaatttttgagaaagtggcaatctttgtccacaacctctattaacacattttttcaagggcattttctctgaaaaatcactgttggaatgatcatataaaggtcccagtgtatgatctgatacttcatcagtacattctaaatcttccaaattcatttcatcataagaatagtgttggtggaaaggtctttacctttacaaaccacttcaactgaagtaatgaaaaccttgtccaggtaactggttctgaaaatccccatgaggttgagtactcacagctatatggaagagttgtttttatctccagcctctgttaacaaaaccaaaatctttcattggaagtgttcctgaaagttactataggcctggttatgaacagtatgcatcttttgtctacaagctttgctaacaaaatcaaaatcatctccagggtctggttcatggaggtcactgtgaggctggtgatcattaaatggtcttggttttgttctaggcacccagttaatgatctccgtctcctcttgggagacattgtaacactgatgattagcaaaaaaaaaaaaaaaaatgaacatcttgatcctagtcccttgctagcaaaatcccagtctctcaagtgtctcttttctgctatgctatcactacactggtattcatcaaaatccctatgcctttggacaggttcattgttggcataatcataattctttatctgtacaccattttgagggtattgatcattaagaagccttgactttttcccagacccatgtgtggcaggggaaatatgctataaattaccagtattttaacaataaataaaagataaatgctattgtattagcaatatctccctttacccaattcagcaggacacaagatgactttggtgtgatgtctcctaaattgggttgtgcctcattttcatttctcctttttatctacttgtgagcccaaaacaccctcccactgaagcagcctcgttgtctggggtgacacctgaggtttgctgtctgacggccacagagatcaaggatgcagacacacaaagagtgaggttaagatcagaaatttaacaggtgaaagaatagttctctgctacagagaggggtcttccaaggactcttttgccctcactatctgcctaaataatctctatctcctgtatcactatcagctatcagactgtaactataagctttaaaaattccaaacttgttttggtgttaataaatttttagtaaaaactggtgaacacatttcccggcatcttttcatttaaaggaatgtgtcataaccaggtcacttttactgtaatttgatgcattaaagaagtaatcttacaaatgtggctgatgacatgctggtttattgtactgacttcatgtcagaagaaacaatcaaaatataacttactcctaaagacattcagctgataacataaaatatttattatataaataacatatttgggctgtttcttgttcttagttactataaataaagctgctatgaacattcatatcagatttatgagtgaacaaaattttcatttctctgggataaatgcccaagagtgaaactgttgggtcatatgctaagtctgtttctatttttataaggaactgctaaactgttttataacaaaaaacactccaacttgaaatagagataaaaaacaatagatatcagttagaatgaaaaaagataacttttaaagacctaggataagatactataattgaccacaaattagaactgtgcttcctagcaacaggaacataaaggaaagtttcattaaaaaacaaaacaaaacccaacctaaataaaaataaccctccaagccccacaatatcaccgatttctggcactaacttttttttttttttttttttgagacggagtcttgctctattgcccaggttggagtgcagtggtgtgatctcggctcactgcaagctccgcctcctgggttcacaccattctcctgcctcagcctcccgagtagctgggactacaagtgcccaccaccacgcccggctaattttttatatttttagtagagacagggtttcaccgtgttagccaggatggtctcaatctcctgacctcgtgatctgccctccttggccacccaaagtgttgggattacaggtgtgagccaccacgcccggcctctggcactaactcctaagagggattttcccaaggatttataagaaacaggaatataatagttattttcaatgttgaagataaatgcttccttggaatgggagagcagagattgtgtgagggaaaggaactgtgtcaaggcaatatgaagtgctgtgggaagttgagctctgtacacccttcctgtatgttatgtcctgtgaggctaatgcctaacagtgcctggcattgctcaagtgctccttctcctgggaaacagaaaattcagaattgtgtctgttctaacttgtattaaatcagttcacagtagatagtctcagtgtattcaaaataagttatatatgtggcacatatacaacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgggaattgaacattgagaacacatggacacaggaaggggaacaccacactctggggactgttgtggggtggggggaggggggagggatagcattaggagatatacctaatgctaaatgacaagttaatgggtgcagcacaccagcatggcacatgtatacatatgtaactaacctgcacattgtacacatgtaccctaaaacttaaagtataataataataaaataaaaaaataagttatatatttcattttttttctcaaaaaatcaaaccaaagacaaacacaaactatttcttatatttaaactagtactgtgtattgtgaaattagttttatagagaaaaatgccatcagagtgcaaaaacttttcaaagatagggaagattgcaagatttttttctattgtctctatcagtttataaatacacacacacacacattatatgtgaaagtcatagaagagattctagtaccatttgataaaccttaattcagtttctgatatattggtagaataaatacaagttattactaagaatcatagcattttagattttgaagagcatagagattatctatttcaacatttcccagtttggagaacattactgtcccatatcataatgcttgttctgtggggaaaaaaagtgagttctgtgcttaaataagttgggaaaatgctgagctaaatacaatttaataaattccttcaggatttctaatgcttttaatgagtgaatgttcatggtcatagtgggctgcatttcccaaacttatttgacttaaaaaaatactttttattcctgtaaaactaacaatatctcatgaaacactatgtttttagaatacagcataagaatagctaactgatctggtccatctcctgtatgttataaattaaatatctgtggcctaaaaaagttatcacttactctaggtcacatacaattaacaagtggcagagctaagatttgaacccaaatttcctgattcccaatcctatggatttcccccactactctgctattatttaaaaaatatgtttcataatttttataaaatattcatttaaaatcatgttactaatgccatgaaagtctttatttggaggctattctctggattcttccatagaattattggttgggggatttgcatcttcatctgaaccccagacacccattccaagattactagaagaaaaatatcaataaacaacagaagcttaaaattcaatcagaaacagtcacaggcttttagaaacataagctgaacacaaaataagaaaaaggcaaatctacacaccattcatatcttgggaatctatagatatgttgccatttgtcgtagtggaaacaagaataatacatcatcaagcacaattttagagagtattttcaattgttaggatatacccattttctcctgtggccaagagagcataaaaattattaagggtttaaagaataggcactatgaggaaagtttaaaggaagagatagagaggaagtgggaaataggttatgggtactgaagtactgaattaactaatgagcccttataagtatttttagcttcaccaaaatataatcaaaacagtatacaagataataatggcattttaatatctttaatagtggagatttagtactaattttgcttactattcctctcttcattagagacttttcaagaactcttgcttcaatagatggttataaattccatttttttcttgttgtagataatacacaagtatcccatgactttaaacatgtttttacttcatcacttataagatgcatataatcaatctgaaattctacagaaaaaattatgcatattataattttgtttaaaaggaattttagctggatagggattcctgtacagtcctttagtacataagtaatgactatttgaggtataaatctcagagctaatagctaacacttattgagctcctaccatatttggcactgtgctaagagctttacttgtattaactcatttaattcttacaacaacctgtgaggtattatctccatattatagttcagaaaactgcagtacaaaaatcataaagtggaagcagtgaaatttaaacataggctttctggctgtgcagcccatgttcttagttaatgctatggactgaatgtttgtgtgcccctaaaatttatatgttgaagccctaatcctcaagtgtgatggcatttaaatgtggagactttgaggagtaattaggtcatgagggtggagctctcatgaatgggaatagtgctcttataagaagagacataaaagagatgatctctttcttggatatgtgaggatacagcaagaaggtgtctgtttgcaaaccaggaagagagccttcaccaggaactgaatgagctggcatcttgatcttgaacttcccagctgtcagaactgtaaggaataaatttctgttgtttacactacccagtgtatggtatttttgttaacagcagtcttaactaagacagccaaaaagttatattgtctctttccaacgaggtaattgattttaagtacaaagcagtggccagccctgttctatttagtacatgagtcaacatgagttcaggaaaattttacttaagtctaatctattcctaattcaaattatttctggccagtttgaataaatcctcccagataactctagttttctttccaatactgacctccaaattacttgagcaggacctgcctttttctgaggactacatttagtctgaaatatctgggtttttttgtttttttttgagacagagtttcgctcttgttgcccaggctggagtgcaaatggcatgatcttggctcactgcaagctctgcctcccagcttcaagcgattctcctgcctcagcctcccaagtagctgggattacaggcgcctgccaccatgcccggctaatttttgtatttttagtaaagacagggtttcaccacgttggccaggctagtctggaactgctgacctcaggtgatctacccacctcggccttccaaagtgctgggattacaggcatgaaccactgcatccagccctctagtctgaaatatcttgatactcaccctctacaagcctttcctctttctgagctgtagcttacctagacacctgaatttccttttcagctatcattcgttggaacccagacctggtaggtgtttcttaaaattttcaggcagtttattttcatgttagctctacagcctcacagaaaatcaaaatcatgtaagcagtagtatgtaaccaatatttgggtcctagaagtacccaagcgtattttaaatgttcatgggaccttgcaatcatcaaatccaaatttttcattttatagaaaagaaaagtgggccaggtgttgtggctcatgcctgtaatcccagcactttgggaagtcgaggtgggcagatcacctgaggtgaggcagttgagaccagcctggccaacatggtgaaaccctgtctctactaaaaatacaaaaaaaacatttgccaggcatggtggtgtgtgcctgtagtcccagctacttgggaggcagaggcaggagaatcgcttgaacccaggaggtggaggttgcagtgagccgaaatcgtgccactatcctccagcctgggtgacagggtgagactctgtctcaaaaaaaaaaaaaaaaaaaaaaaaaaaaaaaaatgactcccagaaaagacagatcacttaaagctagacagtgggaaaacaacaaaagtagtcatttgtgggtccccaagaccagtgtcatccttttaaactagacaaacgcttaaacctcatattttcaattcagtccaacaaatatttatgaagaaccgaagtagtatttgacctaaaatggctagtcaaagctggtccatatttacaatctaattacataggctcttaaaactggagaacctttctggctgtggagatgtgactatgggtgaaagttacacagagatgcaaagttgttgactttgaagatgaaggaagggggccaatatccatgaagtgtgggtggcatctagaagctgcaaaaggcaaggaaacaaatcccctgtagggcctccaggaaagaatgcaggcctggtgacacctgattttagcccactgagaccctcgttggacttctaacctacggaactgtaaggttttttaagccactaaatttgcgataatttgtaatagcagcaatggaaaatcaacccattggcactgatcacaaactcaaatttccaatttcctctctggtccaagtatcaacccaaaaagtagggatgtaaaatagaactctgattcatgagggcagtgaatctagaaggttctcagacatgggtacatgaaatgatcactttttaattttgatgtaattgctcttggatgggaccagacatcaggttaaaaaaatgtcataataaattctaatgtataattaagttcaaaactctattctaggaacaaaagaaaataagcatctgaattgcctgttgagggaataactttgttctctaataggtacccaggactttttctttttttgagagacagagtctcactctgtcacccaggctggagtacagtggcaccaccatggctcactgcacactcaacctcccaggctcaagtgatcctcctgcctcaacctcccaagtagcttggaccaaggtacacactaccacacccagctaaatttttattttttgtagaggtgggatcttcctatgttgcccaagctggtcttgaactcctgggctcaagtgatcctcctggctcagccaaagtgctgggatcacaggtgtgagctactgtgcctggccagtagctaagatttcttagaagacaaacaccatatccttacacccaaactggtacagctagaagttttatagacagcagtcagcacaggttgccaagatgagcaaagctgtgtttcattaaagcattacgagggttatccttcagattttagccaaaggactacgtacacaactgcaggcacctgtgccccagcagttcaatgactttgagagctggtgaagctaattatctcttctctacttaatgcatcaacctgggtgattggtaccaagtgagaaacctgggaatcaacccattcttccccccaactcactcacctacatctctttgccattattttaataagtctctctttaaaaatcttcaactgttttcctcaccatctcttctgccactgccttagattaggcccctaattaatttttcctttaatttctgtaattgttcccacactaatctctgtgcccccaacctacttccattcttcgatactgtgaaacatatatttggtcatagtccatttcctgacatacaactcccaaaacccttggaatctccagagtggtaagagtgccttttgtatactactgagatgactggtgattggggcccctgatagcctcagcacggggactggtcctcagaaaaaccaaggcaggattaaagtgttgggactttcagctctatcccccaacctttggggaggggagaaaggctgtaggttaatctccttgccaatggccagtaatttaatccatcatcctacctaacgaagcttccataaaaatacaaaaggcttgggtttggacaacttctggatagctgaacatgcggaggttcctagaaggtggcttgcctggaaagggcatggaagcctggctccccttcccgcgtactttgccctgtgcatctcttgtctggttgttcctctgtatcctttgcaatgtcctttttaatgaatgggtaaacataagtgtttccccgcatactgtgagtcactctaggaaattaatagaatgatttaggaggggttgtgggaactctgatttatagttgtcagaagtacagactgcaacctggggcttgtgattggcatctgaagtgggggacagttttgtaagactaagtcctcaacctatgggatctgatgctatctccaggtagatagtgtcaacagaattgaattagcggacacccagatggtgtacatagcagaactgcttgatgtttgtgggaaaatccccacacatctggagtcagaagtgttgagtagctgtgtgagagcagggaaaataccttttttcctacatgtaacctatctattcgaatctatcttactctctggtgccagaatgatctaagatacataacttattatgtgacttctacataaaatgcctctgtgactacattttgcctttaggttgcaattcaaatcttcgtaagacaagtcagctccttggagctctcacccttgctatctgcccctaggtgaacctataatctaggcattctcactacttgtgaatcccccatgcgccatgctttcacacctctgtgatccagcttacattgttttctttgcctagccaactcttcctttacatttctgctcagacatcagaatactgactccacttctccattaaccttctctgagtacccatactttcactatctgaaattgccttatttgttgaatgcctttctccagcaccatccacacattcgttgtttcatcccatcatcaaatgtgttttaggtgcccaaaatattccagataccgtttaaacacttagagataccaaatcaatcaaagtccctgtcctcaagagggacagaccaaaagcaagtacacacatcatctctgatagtaataagtgctttgaaggaaatcaagatcatacaatcaacagtgactagaagagaggaacagcactaaataagacagtcatggaaggctggccctctgagaaggtgacatttgaaccgagccatgcaaagataaagcattctaggcagaggaaacagcaagtgcaaaatcccatcatataaggccttgcaagcccacacagatttacaatcttcatggcctggtctgggttaacctgaaataatcaaaaggatcaaaatccagtcgagattattcaagtaaaaagctgggaatagccatttgggagacacagactccagagaaatagagtcagtgttccaaagttcaaagttaaattattgcatatataggcagaaaacaaagaagtttagtaggtttataacattttctagaacgctagtttatgagtttcttttctgtatggcttgttttctttacagttggttttcatttcctttctgatttaaaagaggtatttaacactccatcttaacacggtgtgatagccatgaaacctttgggtgagaaactaaaagggaagttaatctataataaaaatcaacagtaacagggaaggggtctttcctggagccctttagtcatttgtaacattttgtacaacaatgtaagcaaggaggaaggttaatctataatcatagaaacaaagattacagcttcccaggttacagctgcttgtaacgtgactcaggccccataatcacatttctttaaggatcaaaatagtttggagttccaacagcttagattttgaattacttattttcacacctgtcttattcattgctgaatcctcagagctaagcagagtgccaggacacagtaggtattccataaacacttgtggaatggataaagtgtctatttgctggtttacttacctatctccttgaaggcaagggctccttctgacctctgtaggtctagtgttgagctgtatgcctggcacatagaggtgcttaacagagttgctaagcagcatataaaagatgttgcttgagtaccatacagcatataaaagatgttgcatgaataccattatcttcattagagaagataaaattaaatggaaagtattctttaggaatatgccactgagtttaggctaaaagacactaagatttttgaattgttccagtgttgcttagtttcataaagtagaaaactgacatccaggcatgttataaaagcaatcttctcagggaaaaattatatattagtatctataaatagcaatcacaaccttagatggatattaatgttgacatgagctcagaaaatgacttatatgaattctagtaaaagatccccagagttaattttctggtattgttaattttcagatgtcatctattgggaagaacatttctttaggtagggactaaaaacaagcacaagtaaaaggttgcaaagggaagaagactataaggagagaacattttatcaagcagctcttataagaaattaggaaccaataaattttcctcccagaatacctgaataaatactgagaaggaaatccctagctttcaggcaaaattcagtttctggtttgattttatttagcttatgaaacactgaaagatcataatgcaaacaaaacagatatggtgtcaaagaaacaaatatacataaaacattcattctttttatgagctatataaactatcccaaagacctgtgatttgaaaagaaagtgttccttagagaagtggggattttgtacataactgaggtatgcgaaacatttaggggtcatctggcagacatgacagccaaagtgacaagagaatgggaataaaagcaaagccaaagaaagagttttataaaacctctacagtgagaagaataggagacaaccaaagtgattgagagctatcagaaaagaggcaaacctggataattactgtgttcaaaataaaaaaatataagtacaggttgaggatccctcatccataatgcccagaagtgtttcagatttcagatttttgtggattttggcatatttgcactatgccagttgagcatccataatcccaaaatctgaaatctgaaatgctctaatgatcatttcctttgagtgtcagtttggtgctcaaaaagttccatatttcggagcatttcaattttcagatatttggatttggcattctcaatctgtatgtgtagatgccagatgctgcaaagaaaaggctgcaggatttggctagattgttggtgatttctgagaaggcaatttcattaagtggtgaaaacaaaccacacatttaagaagagaatgggacagtaaagaaatggaggtggtgatcacagccaaggtgttttcaaatgtttgacaataggcacaacaagaaagtggaatagtagttcatacaagagaatagaaaccaacagaatacttctaggtatatttgaaagtaagaggaaagcggcaagggagatttaagatgccagagaggaaagtgatagggacagtgagatcctagagctaaaaaggaatcacattctgtagaaatgaaagatttttttctttaaaaaaaaaaggaaaatttttctaagaataaggcaaagactaataaaaagggaaatggggtagtgatctattcttatagtgataattaaattctattgccaataatcttaagctttattgtaaagaatgaatctaaatgggataatggcagaaagccactcaggaatacaaaatgcaaattataaatagggaaatgcaaattaaaagcacaatgacataccctttcaaacccactaaaataataaataaaaatgatagacaataacaaatattggcaaggctaaactcaccttaaatagttgggcaatttgtttaaaagttaaatataaatttaccatatgacccagaaatttcactcctagatatcaatccatgagaaatgaaaacatatatccatacaaagacctccatatgaatgttcttagcaaccttattaacagtagccaaaaatgggaaacaactgaaatgtccactgtgaaccctgaatatctgagataggtctcagttaatttagaaagtttattttgccaaagttgaggacatgtgcctgtgagacagcctcaggaggtcctgatgacatgtggccaagatagagcacagtttggttttatacattttagggagacatgagacataaatcaaatatataagatgaacactggttttgtctggaaaggtgggacaactcaaagctgggagggggcttccaggtcataagtagataagagacaaatggctgcattcttttgagtttctgattagcctctccaaaggaagcaatcagatatgcatttatctcagtgagtagaggggtgactttgaatacaatgggaggccggtttgccctaagcagtccaggcctgacttttccctttagcttagtgattttggggccccaagattaattttcctttcacaccacctactgatgaataggtagacaaaatgtggtatatccatataatgtactattattcagcaaaaacacaaatgaactactgatatatgctgtatatcatggacaaacctcaaaaacattatgctaaacgaaagaagccaaacacaagagaccaatattgtatgattccatttatatgaaatgtccacatgagacaaatctctagagacagaaactacattaattgttgcctggggtgggggaataggaatgaacaattcatgaacatgaaggttcttattagggagatagaagtgttttaaaactgatgtacagtaatagatgcataaataggtaaatttaataaaaatcattaaattgtatgcttgaagtgggtgaattatatggtatgttaaatacctaaccaacaaacaaatggaaacacatcccatgtacatggatgggtagattcaatattgtgaaaatgaccataccgccaaaagcaatctgtaaattcaatgcattcccatcaaaataccactgtcattcttcacagaactagaaaaaacaatcctaagatgcatatggaaccaaaaaagagcccacatagtcaaagcaagactaagcaaaaagaacaaatctggagatatcacattacccgacttcatactataaggccataataaccaaaacagcatggcactggtataaaaagaggcacatagaccaatggaatagaagagagaacccagaaataaagtcaaacacttacagccaactgatcttcaacaaagcaaacaaaaacataaagtggggaaaggataccctattcaacaaattgtgctgggataattggcaagccacatgtagaagaatgaaactggatcctcatctcttaccttatacaaaaatcaattcaagatggataaaagacttaaatctaagacctaaaaccataaaaattctagaagataacattggaaaaacccttttagacatcggcttaggcgaagacttcataaccaagaacccaaaagcaaatgtaacaaagataaatagatgggacttaattaagctaaaaagcttctgcacagcaagataataataataataataataataatagtaatcagcagagtaaacagacaacccacagagtgggagaaaatctttgcaatctatgcatccaatgaaggactaatatccagaatctacaggaactcaaacaaattagcaagaaaaaaacaaacagtcccatcaaaaagtgggctaaggacatgaatagacaattctcaaaataagatatacaaatggccaacgaacatatgaaaaaatgctcaacatcactgattatcagggaaatgcaaatcaaaaccacaatgcaatactaccttactcctgcaagaatagccataatcaaaaaaataaaaataaatagatgttggtgtggatgtggtgaaaagggaacacttttacactgctggtgggaatgtaaattagtacaaccactatgaaaaacagtgtggagattccttaaagaactaaaagtagaactacatttgatccagcaatcccactactgggtatctacccagaggaaaagaagtcattatacaaaaaagatacttacacacacttgtttacagcagcacaattcacaattgcaaaatctgcaaaaatatggaaccagtacaaatgcccatcaatcaacgagtggataaagaaaatgtggtgtgtatacacacacacacaaacacacacacacacacacacccacgagggaataccactcagccacaacaaggaatgaaataatggcatttgtagcaacctggatggaactggagaccattattctaagtgaagtaactcaggaatggaaaaccaaatatcgtatgttctcactcataagtgggagctaagctatgaggacacaaaggcataagaatgatacaatgaactttggggacttgggggaaaggctgggagaggggatgagggataaaagagtatacattgggtacagtgtacactgcttgggtgatgggtgcaccaatatctcagaaatcaccactaaagaacttctgcacgtaagcaaacatcacctgttccccaaaaactattgaaataaaaaatattaaaatgaataaacatcatatataatttggtttatccagtaaatgactaactttaagagaaattcacaaattgattttaaatgatttaaatttttgtaacaaattagaatcccttatgcttgataaaacaattagtaaaactaagtagaatcaagtaatcttttctgcattttagtgttcctgattcttttgagcaaatatagaaggcctgaagacaatttcattttagagtttaagaatttttcagaatttgtttgatccaaatccctccatgtactggggtcacttgtgacaagaaaaaagaaaaccttgaccatggtcacatggtaagtcggtagcagaactagacaaaaactcagctctcctgatttctaatctaatacttttttcattatcccatgcaacctcccacattttcagaacagaaacagaaaaattagaaggagaaaagtaacccaaactcataggactgtatcttttttggattcctacaaatactcttaagctttgtttcaggaagcagttacttggaaacagtttgatcctttcaggtctcgctgttaagacttattaggtaagatcagagtagtgtttagtctagagttcattccccactattgagacaaggcccttctgaactctacccagcatcctgtgaattatgaggttttccatagatcagagtagtgtttagtctagagctcattattccttactattatgaggttttccatagatcagagtagtgtttagtctagggctcattatttcccactattgagacaaggctcttctgaatgctacccagtatcctgtgaattatgaggttttccataacctcataatggctggtgggaaaagtccctattgccagccctaagtgagctccaagtactgttccttctaatcttctagagtagctctttctccagcctcaggtactttcctgaaatgcagggaaaccttctgcattccaggaaagtatctgagggttggtaaagagtaccctagaatactctccctgggcagtactctcttgtccagtgctagctgccttggtttcccaggcgtctcagttctgtccccttaacttggcagtgacttgctccatcatgattcccactttctgcaccatgacctggaaactctctcaaggcagcaagctggaacatttctcagagatcactgtccttcattgcctgatatccaacttcttggaaattgttgtttcatatattttcttcacttttttttttgttgtttcaggtgggagggttaatctggtccctgttacttcctcttatctgaaagcagaagtcccagtggcgtcattttttttttcttactctgaaatcttgggtctaacaactctctcctactttatgaattggctaataacaattccttttcttttaatagccttttcttttatctgttctcataatgagaagcacaattaaatgcttataaagctttggtaagaggtacttggcaaaaataaacaatttaagtatgatgactactgacaaagactctccttaagcaaaatttagtcaggttcctttgagcccattctctactaggcccggtacttgggccttgtcctcaagagcaagaatcctgttaagtcagttttgtaagaatcccatcctcatatctgacctccttcaatatctgatcaaattcctcatcctccattgcccccgaggtgttgtctgatcatcctggcctgccttcagcaagaatcctgttaggtctgtttaaccagaattacctcttaccttgatgtttcctcctaggaattttccatccaccgaccccactctgttccttggtatgaatccccccttattcttcttcttttcagaactgagcacagttctatactcaagtcccttactttattccaatagttcctgagtaaaatctattttttactgctttctttactgtctagctctggttttaatactatgtctaattttacataaaaatcctttatcacatattccacactttgaaactctagcactatcaacacctaagctgaaaatggtctcttatcccttaaaattaaggttgtaaaagtattaaactaaacaataaaaaaaaaatccaccttgttgtcattggctctaattctatatactccaaatacaaacaactgtagtgattatgtcccatttaagattctctgcattccctttccacatattgggaattatttctataaaggcagtaagcagggtcaatgaaaactttaatcattgcattttggagccaaaggggacctcagaaaatcaatttctaattgctgtctttgtggaggtcaaaaactgaagtcttgaaagaatttaactgtcttactactatattataggagacatgagactcagtcattatccatcttgaatttttagtgatttaaaatgtagtattataggccgggtgcggtggctcacgcctgcaatctcagcactttgggaggctgaggcgggcggataacgaggtcagaagatcgagaccatcctggctaacacagtgaaaccttgtctctactaaaaatacatacaaaaaattagccgggcgtggtggcgggcacctgtagttccagctactcaggaggctgaggcaggagaatggcatgaacccgggaggcggagcttgcagtgagccgagatcgcaccattacactccaactggggcgacagtgcgagactccatctcaaaaaaaaaaaaaagaaagaaaatttagtattaccattgaactcaacacttgaaaaatggtagaaccatccacatgcatagtaaaactactatttcctttgacttaaatctggaactttaaaatatcagactttaaaagtgcattagctttttaatcactggcatcatactgcatctagtaaaattccactttttcatgtgaactgctaagacagatgctttcatatcttgtcactgcaatttttagttttctcataaggtctaaaaattattttcctctagagcagggttttaaaattctgctcttcgaagtgtccttctgccccttagtctgtgggtggaaagtgaaggaaggagaataattatcatgtcaagtggactaagtctggatcctcaatcccctgcttcaaccaacccaactccccacttaccatatctgctttatataacgggcttcggagcaagatttaattgaaagatttctctgttaaagttcaaaaattactgttgtaatacccatctcacttacgtttttatttcttccgttttcatcatattgctgtctttccctccttttgtttctctgtccctttttcacttttcctatttgcaactatatttccttctagttattttgcttttttaaaaggataagttcagtgttttttttcctctttgcacaaccaatggtttttagaaaaagaatattgtatgagtatatgaaggactaaaaacattgctaagagattattcatgggcaattctgaaattaatattaaaataaccaagagaatatcttaattcactttccaagtgcagtattaaaaaaaaaattcttgccagatgtggtgcctcacgcctgtaatcctagcactttgggacgccgaggtgggcagatcatctgaggtcaggagtttgagactagcctggccaacatggcgaaaccccacctctactaaaaatacaaaaattagccaggcgtggtggcgggcgcctgtaatcccagctactcagaaggctgaggcaggagaatcacttgaacccaggaggcggaggttgcagtgggccgagatcacgccactgcactccaacccgagtgacagagcaggactctgtcttaaaaaaacaaaataacaacaaaacaaaaaacaaactttctattttaagacctacccatgataacaatatacatttgcaactttaccttaacttcataatatcttgtggtgtatgttaaatcaataattaatccgagctcctcatttagtgcttttattgcgctaatcaagtcttttggtataaacttctgggttggagtaagtctctgattaactgtctatgatgaaaaatgaaaaataaggttataaaatacagataaaatgttaacattaaacatagaacaaggaagagaaaaaacataagacaataaaaagacttggtgaaaatgtcatagcataagaatattgacaagcttttaactaactagagctgtacaaattgcctaaacatattcacatcctttgcctcagtgatttcatgtcttggaaattatcctaaggcaagtatcagaaatattggggaaaaagagtttgggcgtaacattcactgcaacattatgtataatagaaacacattggaatatcatgttgctgttaaaaatcacatttctcaaaattattattattattattattattattattatgagacagagtctcactctgtcacccaggctggagtgcagtggcgcaaccttggctcactgcaagctccgcctcccgggttcacgccattctcctgcctcagcctcccgagtagctgggactacaggtgcccaccaccacgcctggctaattgattattatttttttaaatgaggtctcactctgtcacctaggatgtggtgtaatggtgctatcatagctcactgtattcttgaactcttgggctcaagggatcctccttcctcagcctcccaagtagctaggactacaggtaggcaataccctacccaggtattaattttttttttttttttttttttggagatagggtcttgctatgttgttgcccaggctggtcttaaacttctggcctcaagtgatcctcccaccttggcctcccaaagtccttggatttcaggcaccagccaccatgcctggccacaaagactatttaataaggaaaaatcctcaaaatgttacataaagatcacatcacaaaacttttacatacagtgttattctgatttatttttgaaggggtaaggagaaggaaaatatatcacttttaaaagtggaatttcaattgtttttcttctatactcatatgttttccattttttttctatttccaacagaaactttctgtaaatgctactgtcattacaggataaacttcaaatctactgtgattctttaaggccgtatacacacagacttatccatatattgagtcttacctttcaccacagatcccacctggaaacactctccagtccggcagctctccttacagtccaacaaataccttaagttcgttcctctttctgtgtcttgtacctttccttaggctccttgaccatctaaatcagggtttctcaactgggcactaatatttggggtgaaacattgttgtggggctgtcctgtgcatcgtgggacatttagcagcacccctggcctctgcatactgaatgccaagagcaccccctccccagaccctccaagttatgacaatcaaacatgtctccagacattgtcaaatgtctcctggtggacaaaatcaccctggcatgactcactgaaactaatgctttaagtaattaatgtaatatagtccaagtacataagtctgagtggtccagcttgatccatagggagtgatgaatggactgcacagtctttaaatgaccttctgcaataatacttctttcagccaaacttctgagaaaaagttaggaaggacaattctagattctactctctcacaagaatctgatgtgctggtgttttatattgcttaagaatggatccatacaaattagaggcccacagatatgaagagcaaacccacagtatctagcacttggtaagcagtcactattttttcttaaagccaattagacaataaggctggcatcttactgagcaagataagaaactagaactcttacctagatagaagagttccatctagaggaagacttgatactagagaacttttatatatcaccaatcctaactgccccttgaggccactcctaatttgcaaagtaaaagtatgttatcagtgtactgaagataattacgcaggagtatgcacacagttcatttaaaagctgtaaatggttagattcacattgaaaggaatccaggatagtcttattttgcacttttaaaaatatgtatttaatctgccacgatatctgctatctgtagtgttattaaaatgcaggttttcatcattctcagcaaagtaacacaagacgagaaaaccaaacatggcatgttctcactcgtaagtgagagttgaacaatgagaacacatggacacaggaaggggaacatcacacaccggggcctgtgggggggtgggggctggaggagggatagcattaggagaaatacctaatgtaagtgacgagttgatgggtgtagcaaactaacatggcacatgtatacctatgtaacaaacctgcacattgtgcacatgtatcccagaacttaaaaagtataatttaaaaaaaaaaagaagaaaaatgcaggttttatagaaacatcagttaactgaagtatatattaagtttatgcgacttataactagttactgtctactaaaacaaaggtcaatgtaagctgtgcataacaaaatattaaatttgacagaccttcccacaaaataggtatactactgctctataaatctatagatcaagaaaactgatctatagattgatttataggtcaatagtatggctatatttgaatctcacttgcttttcattaagataaaagtgaattgagaagcaagcaaaatagtgttttactgggcaacactggtaaatatcagggtctaaatttaatctgaggaacataaaaattcctcagattattttgcaactattcataatatgaaaagtcagatttatgcagagaatcaagatccaattacagagcaacttaacataaaagctctataagccacacacttttaaaaatgtatcaaaagcaggtactaccaagaatatacagttgctaaaattggggaggtaaatactttgttcaactccaaataattggtgacagtataaatttctttaagccacattcttcttgccaggaaagaagctgggtttaaggaaaactcagctgcttgctaccgatttgagctggaagaatgagtcaaactaacattcacttatgcagcagacagcaaccctgttcacacctttgtcttaagttaggtgacggggcatcaactaccctttaggacacctacaattccatggtaaaatgtcagcaataagctgggccttgttctcttttggggtctcagagtggtcttaccctcaaccactaaatgtaaaagaatccctttgaaaatcaccccccaacttttgaaaatgaatgctgaactgaatagtatttttttggagtgaggttttgctaaagaatgagcaataataaatttaagcttcaattactttttgtgctattgctatataattttgagttagttcattttgtaagtaacaaagatgaaaatcacaaaagatttattgaaagctgtttatggcagcatatactaaaacctagatgcaaagacagttcctttctcattttggaatcagtatttattcttttctaccagcccccatccctgcccatctttctctctcttcttgtgtgtttgttttgcaggggaaagcagagggggaagtagagacctttctttttttaggttaatacagtgaaactccacttaaaatggacttcctggattcccttccagagattggttcaaaaactctgtgatggagttcaggaatctgcattttaaataaacactcctaataactttgatgctggtagtccaagaacaacactgaaaagcaaggtgcatggataagtagagtagtgttttgccaggtggaacagtccattctaggcagagaacagaagtaaaggcatgatggcatcaatgtgcatcatgtgcctgaggaacaggtgcttaaggtccttaactttgctggtcctcagtttctgcgtctgataaaagaagagctgacctacattgtttttgaggtccttcccaaagttaatatttgatcatcacccaaagtacacaggaatcatggttcactgttcacagatgatactgtgctaattgctactcatttattcaacaaacaaatgaagaaattcagtgtcagccctcagtttttagtctggtggagagagagacagatgagtaattactatacagtgccatacagaaggaattagtggtggcatcacaaagaaagtaatgcttgagcagaaactttatggggaaaagttgacaggattccagcaaggaatggctcgtgcaaagaaaactacatgctgtgaccaggatacagttaatggtttagcatggttttagcacagtgtgcatgctggagaatcgcagaaaaacaaagttttggaagaaaggagctagttcatatatgtcaggcagagctcagattttactatatggaggaactgaaagcaggggatcaggtctgcactttaggaacacagttctggtgataatataatgaaagaaacaagaaggagataactgggagacaagttagttagtcagtgaatgtcaagagatgctggctgctaaagcacagccatgaggacaaagacaggctccaaagaacagctattcaggcagcagaattaacctgctgaatgtgtgtggaatgactttaaaaaatggaatttcaggattgttcttagttttcactggggtgactgagcagatactggcctcattcacgaaacaggaaacacagggaataagtctggggagggaaggttggttttgaactctatacatttcgggtactttgggtactggggtaagggtgtcaccgtcaggagctcaggtaagaagtccaggctaaagagagatttggaggtcatttccctaaactggtggttgaagctaagagattactcatagggaacaacagaaactgaaaagagaaaaagatcaaggacaaaaccttaaagagcaacaactgcgggaagggggacagagggaaaggtttgtttatttttatgacaaacttcaacatgtctagatgccaaggagaagaaaatgactacaaaagcatagaaaaggtattagagcaagcttgtccaacctgcagcccacaggctccatgtggcccaggactgctttgaatgtggcccaagacaaatttgtaaactttcttaaaacattttgagagttctttgcaattttttattttttgagctcatcagctatcgttagtgtattttatgtatggcccaagacatttcttcttcttccaatatggcccagggatgccaaaaaattggataccccacactagagcaagatcccagaggaactggtactgcaaatttaaaataacctaagaggtgggagaagaatggtagaaactgatgtttgcgaaaacaatgaaacaaggaaagttcaagactgggaaatggtctacagagccaagtgcagaaaagaagcctaagaagatattttgggtttggcaatcacaaagtccttggtggcatgattaggtggcggaagccagaactctgtgggtagaagagttaacaagtaagggaagggaaaaaaagattacctttttctctaaatgtggctgtaaaaaaggagagagagaagaaatctgagaataatcccagttgatggtttttctttttgtttttgttttgttggatagggcagataaagccaggggagggaggtggggaaagggtatactgaagataaaaagggagggttaaatgatgaaataaggccccagaggagacagaatgaatgggatctaggacatatattggatcatctgtagatagaaaaaaaaaaaagaaataaatcaaacatacctcttcatctgagacaggatatctgctgatgttaagttggcctggtggtcagtgtcacagtattcatgtctgagagtctctgtttcctctgaaaaagccaagccagctgctgaaagtacaaggtcaaaagtagagtaggtttaaggaacgataaaagttagaatagtagctgtgggtgagaaaggaaaagaatggctgagctacattatggaccatgccatatcatcatggcaataatctggttacatgattttcactaatacaattacctttctatatgaggagagaaagcaaatggctagactaaactagaataggtatgctggacaaaagtggaagaaacacaaaaggcaaagaaattgtggatactgatgtgggtaaataataaaacaaggagtgtgggctagacaaggaagaaagtcaatgtaggtagaggctgatgatgacaaaatagtcatcaagggacagcgtcttcatgagatcagggattaagtatagaagaataaggcagaggaagagatgaaagaaacaggaagatgagaagagaatactagagttcgtgattgttaatatggaacagtcttagatattatggtcctgcagtcagtcagtcatggcagtaagttaagggaatatggggtgctggacctgtgatacacatgactgctttagtccccccagaaccttgtagcaattgagtatgaaagaaagactggccaggcacagtggctcatgcctgtaatcccagcactttgggatgccgaggcgggtggatcacctgcggtcaggaattcaagaccagcctggccaacatggtgaaatccggtctctcctaaaaatacaattagctgggcgtggtggtgcacgcctgtagtcccagctactcgggaggctgaggcaggagaatcgcctgaacccgggaggcagaggttgcagtaagttgagatcacaccactgcactccaaactgggctgacagagactccgtctcaaaaaaaaaaaaaaaaaaaagacttgagttgggtactaaattccttaatgaacatgagtgaccaggcagctggtaaataacagtgaggagagggaaaagggctcattagagaagggtttctggtaagttttacaagggtggaatggaatggcgtagcaatggccatgaggagatggcgaatacagataccagctctgggtcctggggtgggatggaatggcctagcaatggccatgaggagatggcgaatacagataccacctctggggggcggggggcgcgggcaggcacggctttcgctgtggtgaattgctgggaaagcagtgtctccagcaggcatggctttcgctgtggtgaattgctgggaaagcagtgtcttcaggagacagccaggtacccaatatcacaaggaggaatgttttgtgaacaagaagatataaagacatagaggggtgagaacatgtggtgtttggttttttgtccttgcgatactttgctgagaatgatggtttccagcttcatccatgtccctacaaatgacatgaactcatcattttttatggctgcatagtatttcatatgagaattgaacaatgagaacacctggacacaggaaggggaacatcacacaccagggcctgttgtggaatggggggagggggagggatagcattaggagatatacctaatgtaaatgacgagttaatgggtgcagcacaccaacatggcacatgtatacatatgtaacaaacctgcacgttgtgcgcatgtaccctggaacttaaagtatgataaaatatatatatatataaatttaaaaaaagatatagaggggtttacatatgaggagtctagaaaaagagtttacagtttccagaagaaggcagatagtgagacgatcagcagatggagaaggtgtgggaatgaggctgcgagaagggataaattatctgggttgttaccaagtatgacagagactatagacagggtgggatttacggtctcaaatgaaactgtgccaagctgtcagagacactgggactctattttgcttactaaggttaaacactagtattacttttggtcaccatactattaaaaaataaagacaatcctacgaaacttaggcaattaatatcagaataaagaggtcaataatgtttattctctattaacatgtacatttagaaaataaaagcaaagcttaaaaatgcatggaagtcttacacaagacgactgttggggcataatgcctgacacagaacgcagttaaacactgtggaaagcctgaatgagtgaaagcatacaaaccaccaccgtgcggctctctacactagcaagtttccgaagttcgccccagccggtttccctgaacaagttcccaaccgcatcacgtttagtttatctcgttattttaactcggagcgaggcaatgggaaaaagaaaaacaatgagagccgtactctgtttattaagcgatgaatgacgacacatgggtgagcgtgtctggcatgccctatttaagactttaaacatagtacattagtacgctaacagcaagctctggaaataaaaggaaccgcttgcatatttagggggctcttttgtaagccacaaaggaaatcacctgaagtcaaagctcccctcttttcctagcaaggcagggacgacggcaaagagaaagtaggtcccggggcgctgcaacccgtgcaacttgccggctggcgtcccccggcctcgcgcctccacgccctgcgcgggcgaccgctcttgccacaacggcgccccgcagcgtcctccccggggacgcccgctcagccgggagctcgcggccggtactcacccgctgggtatactcttcttcttcaccaggacgagagggatgagagacccacgccccaggcaaccccgctctcaggcctcctccagaacagaccccagggtacgctacaactcacacgctcacgggcagaggcgaggggcgggggtgatagaccccggcggcgaacagacttggcgcaccgaagattcccaaaggcgcgtgctccgctccctctgggtcctggcaggccaggggcggcagcgcgcatgctcctgggtcgccgctacttgcagcccgcgggcgccgtagggctggcgcagggtgcggtggggcggttggtgatcatcctagcctgcggtagatggtgcgccctgccttccctgcccagacgtaagaaaagtgcactgtccgtccaggtgaatgtcgggctgctggtgaaggtttctctgattcttccctgtcagacattcccgcacttttgtggagctctgctgcatgggcagaactagctgggctgggataaccggagccggggccgcgcaggccgctgggacttgtagttcgggggcctggccgaccggtttgttagccaatttgggaatgagtagaattgaaaatcactcgagagcagtgtttgatttgcaagaaatacgggtcggcatattattaattcagtgcctactgtgtgtgctgaacaccttgccttagtcctgatcttcacattaggataagcaggaagatgaacttggaaggtagaatgtaatgaacaaaaattcgcattatgaactacaaatgctgttggagatcaagagacagagttagaaaaaacttcctgaaagacgtggagtttgaatcagccttagaaacacggaatgctatccatttgcggggaagttgtaaaaattaaaggttggagatgccagggagaataaacaagaactccatccagctatagttgaggggttatgttggagagtggtcaatgttggagagtggtcactgcggcttagatggggaagtgatgtgagagttttttggcttcactttcagaaagggcctcctggttgactttctctctaattgaggctataagtatagacacagagatacatcttcaggtttgaataaaaaacattacagtacttgtttagagcttctgggcctcctggccagtggttgctctaagaattaatacatttttataaatcttgtaattcacctttgagtagcaaaactacgttgcatggtgtgtgttagatgtaaattttcaaaatataatatgatagtttttgtaacctgtttccacattagttttcatgtaccagaagtcccaagatagagaagtgggcccaaatctttcttgatctacaggagcaggacatgatgacttgggaactggtcctcagagcagtgggtgatttagttttgttgcctttcgaagacttaaataaattcacagatcagaaaatcttttgtcacgccgtttgttcctaagttttgattttggaaaacaagataacagttaagttaatttttaaacttgccagttaatgcaatacatggaagtcataatgttttttgtagaacactgtgaaatactgctatattcctcttaactaagtaaagaattgttaagttaaattccacttcttccatatcctaataacaataaagggtagctggtgctatatatttaatagattatttttacaaaatgctattgttgccttaattacatcataactgtgaatgagaccttaattctggacatagcatcctaattcaaattaagtctggaaggcatcatttaggaaacattgctataagagagttcagaaaggtgtcatcatactatgtgacaatagatgaactgagataaagataaaattggattttggtctgaattcagatctgctaaggaaggaaagtgcattaatacatttagaaatatttctaacaagagccaggggaagattaaagggaaccaattttctgattggatcacaattaaagatatgttactatatactaagatatgcattgtgtaaccatttccacatgctagaggtttttctgtggttttattttgctagcactcctgaaaccaaatggcctgtgacagaagtaaccaaggtgactgaaaattgtgccaaaaagaagtctgtgctgattcagggatccacatagtcttgtgcccgcagaattgatttagaaatttgtttaggcaaagcgcagtggctcatgcctataattccaatgctttgagaggctgaggcaggaggattgcttgaggccaagagtttgagaccagcctgagcaacacagcgagaccctgtctgtacctaataataacaataataataattagccgagccttagagacacatgcctgtagtcctagctactcaagaggtggaagcaggtggatcacttgagcccaggagttcaaggctgtaatgagctgtcatcatgccactgcacttcagcctgggtgaaagagtgagaccctgtctctaaaaaacaaacagataaacaaaaacttgtgtggcattctagtttctacaaatgtctggggaattgcatgaacttgcatttaaccgtcatgttgaatgatactcttgtattaggccattcttgcgttgcaatagaagaatactgggtaatttataaagaaaagagttttaattggctcacagttctgcaggctatataagcatggctctaacatctgcttctggtgagggcatcagggagcttacaatcatggtggaagggaaggggagccagcatgtcacatggcaagagaggaaataaaggaaggaggggggaggtcctagacagactcttttaaacaactagatctcatgtgaactaactgagcaagaactcatcatgaaggggatggtgctaagccaaccatgaggtatccacccccacaatccaatcacttcccacctggccacatgtccattattgggaatcacatttcaacatgagatttggaggagacaaacatccaaatagatctctagtatctattagtagccttttaatcaatttccctgcctccatagaatatctatatttaatcattgcctcttggccttttggctaagatcaaatgtatatttaatcagatccttttttttcttactgcaaagttttatacttttggggggaagggaattcatacatattttaattaaaataattccttagtatcttgaagtttttttcagtaccctttttgtgaaagtgatttttttctagtacattagcatgtagggaagatactgacttttacatatattctcttgtattctgccaattccaattttctaattatgtctaaactttatttagtcttttgggtttttcatgtataaaaacctatcatctacaaacaatgataattttgttttcctcttccaagagttacacctcttacttccttcttttgcacatcttattgcattaaccgggatttctattaaatactgaaggtgaccaaatacaaatatgaaatagtaaaagtgatagtatatctgttttgtttcttgttaaattaaaaaatttaaaaagcatacttttaacctcaagtatcacaagtcagttttcttatgatatgtcattctcaataatatttcttatttatttagaaagttgaaataaaaggaccatcatgaaaaaatctcaaagagaagatatttttaaaaaggtaaggtattaatggagtttataatattttgattattccaaatagccctgttgtaaatgggggataatcctgataaatgtgatacatttgtttctatatacaaatcataaattcatatgtaaaaaaagaaacaataggagagtttagggatgaattgtattcttatttggtctgtaagttatttaataagatgaattatttatgtatgtatttatttaatctcttacttcaatatctatttgtttatatgttctctcacctagccaacaagccattccctgctttgttaaaaaagatgtttgtcagtgagttaaatctatataggagcaatatttacatgtctcttagagtaactgcaattaagattcacattttatccctaccttctagatggaaatgagaacttatgaaaaagtatacaggattctgggaatggtgggcaagatatttgggaactaataagggagaccctctatcagttacttgccagaattgttccatcataccttaagggttgctatcccctggtcaagagtagaattaggtattttttattgtcttgaggtaggtactgaaggttgaataagatgtaagggaacattgtagtctgtgttgaccttattcagtagtttttaatagtggtacaagaacgaatagtagattttgaagttttttcggaaagtttatagactgggctctttttatgatattttaactgtgatcatgtcaatagcctgctttggtttttgacacaaattcatgtttttactgtgattagaaagcttgagatttccaactgcacattagtttggttagcatgtacagttgttatttcaggagtctttgctattatattttttagcattaaaattaaaaagaaacttataaccatatcattctaaaaagggtttaacattgctagaatagtttacctatagaatattgaggtttataaaaactggaaaagaaatgcttattttaacatactgaatttttgttgatgatacaacattcaactagaattaccagaagtcagctagaaatatgattttgatgcttaggagagtgaaggctggagacacagatttgggaatccatgggaatatgtgcaccctccaaagctttggaatgtacccaacatttaggatatgaagaggtatgaccattgaaggatacagaaataagtggccacagaggtagaagggtagagggcaaggatatataaagttttcaaaaaataaggttgctgaacgttgccacacgctgcagggtaataaatcaagtaatagctaaaactagtatagcattgaattttcaaagtattttcatatatgtctgatctcacttgaccttcttaaaaggtacatgaagtggtaatacatgaacactaagaactaactcttggattttatcattaaaaggccttttttatattccagagaacaatttctttttggaaatttttaatttttatggatacacagtaggtatatataggtatggggtacatgagatatttttatacaggcataccatgtgtaataatcacatcagggtaaatgggttattcattacctcaagcatttttatcatttctttgtgttataaacattccaattgtattctttcagttattctaaaatgtactataaattattgttgaccatagccacccttttgtgctgtaaaatactagatcgtattcattgcattgtacttattaaccttccccattccctgccccccacccaatacctttcccagtctctggaaaccatcattatactctctatttccgtgagttcaattgttttaattttcagttctcacaaatgagtgagaatatgcaaagtttttctttctgtgcctgacttatttcacttaacataatgacctccagttccatccaagatgttgcaagtgataggatctcattcttttttttatggcagaatagtactccattgcatatatatatataccacattttctttatccatttatctgttgatggacacttaggttgcttccaaatcttggctcttgtgaacagtgctgcaacaaacatgggagtgcaggtatgtcttcaatatactgattttctttcctttgagtatatacccagcagtggaattgctggatcatatggtagctatatcttcagttttttgaggaaccccatactgttctccgtagtggctgtactaatttacattcccaccaacagtgtattagggttgccctttctcaatgcttttgccagcattcattattgcctgtcttttggttaaaagccattttaagtgagtgagatgatgtctcattgtagttttgatttgcatttctctaatggtcaatgatgttgagcatcttttcatatacctgtttgccatttgtatgtcttcttttgagaaatatctatgtagatcttttgcccatttttaaatcagattattagacattttcctactgagttgtttgagctccttgtatattttggttattaatccctaatcagatacatagtttgcatatattttctcccattctaagggctgtttctttgttgattgtttcctttactttgcagaagctttttaacttgatgtgatcccatttgtccattttttgctttgattgcctgtgcttttggggtattacttaagaaatctttgcccagaccaatgtcctggagagtttccccaatttttcttttagtagttttatactttcagatcttagatttaagtctttaattcattttgatttgatttttgtatatggtgagagataggggtccagtttcattcttctgcatatggatatccagctttcccagccccctttattaaagagattgtcttttcccaatgtgcatttttggcaccttgttgaaaatgatttcattgtagatgtatagatttatttttggtttctttattttgttccattgatgtgtatgtgtgtgcgcgtgtgtgtgtgtattttaatgccagtgccatgctattttgtttagtacagctctgtagcacaatttgaagtcagtggtatggtttggcttttagtatagctttgtagtacaatttgaagtcagtgatatggtttggccgtgtccccatccaaaatctcatctggaattataatccccataatccccaagtgtcaatggggggaccagatggagggaattggatcacgggagtggtttcccccatgctgttcttgttatagtgagtgagtgagtctcacaagatctgatggttttataggtgtttggcatttcccctgcttgcactcactctgtcctgctgccctgtaaagaaggtgcctgcttctcctttgccttctgccatgattgcaagtttcctgaggcctccccagcaatgcggaactgtgagtcaattaaacttctttcctttataaattacccagtctcaggtatttcttcataacagcgtgagaatggactaatagagtcaggtaatgtgatttctcgagtcttgtgttttcctgctcaggatagctctggctattatgagtctttttaggttccctataaattttaggattactttttctatttttgtgaagaacgttcttggtattttgatagggattggattgaatacgtagattgctttgaatagaatggacattttaacaatattgactcttccaatctatgaacatgaaatatctttccattttttgtgtatcctcttcagtttcttgcattttatagttctcattgtggacatcttttacttatttgtttaagttaattcctgggtatttaatttgatttgtaactattgtaagtgggattattttctagatttctttttcagattgtttgctgttggcatatagaaatgctactgacttttgtatatcaattttatgtcctgcaactttgctgaatttgttcatcatttctaatttttttttgtgaagtctttatgtttttctaaatacataattatatcatctccaaacaaggataacttgagttctttctttccaatttggatgccctttatttctttcgtctgattgctctagctaggactttcagtacatgttgaacaacagtggtgaaagtaggcatccttgtcttgttccagatcttagaggacaggctttcagtttttccctgtttggtataacattagctgtgggtctgtcacatatggcttttagtgcgttggggtatgtttcttatatacccagtttttgaaggttttttcatgaagcgatgttgaattttatcaaatgctttttcagcatcaattgaaataatcatatggtttttgtctctcattctgttggtatgatgtatcacattgattgatttgtgtatgttgaaccacccttgtatccctgtgatgaatctcatttggtcacgatgaatgatctctttaatatgatgttgaattcggcttgctagtattttgttgaggatttttgcatcaatgttcatcagatacattggcctgtagttttctttttttgatgtcactttgtctggttttagtatcagggtaatattggccttgtagaatgactttggaagtattcccttgtcctctattttttggaacagtttgagtaggattgatattagttctttaaatgtttgccaaaatttagcagtgaagccatcaggtcccaggcttttctttgcttggagactttttattatggctttgatcttgttacttattattggtctattcaagttttggatttcttcatggttcaatcttggtaggttgtatgtgtctaggaatttattcatttcttctaggtttttaaatttattggcatataatttctcatagtagcctctaatggatcctttgaatttctgcagtatcagctataatgtctcctttttcatttctgattttatttatttgggttttctctctctttgtcttagtgagtctggctaatgatttgtcaattttgtttaacttttcaaaaaaacaactttttgtttcattggtgttttgtatttttttattttaatgtgatttatttcctgctcttgtttttactatttcttctatgaattttgggtttgatttgctcttgcttttctagttctttaagacgcatcattaggttattttaattttttttcttttaaaaaattttttgacatagacacttattgctgtaaactttcctcttagtactgcttttgctgtatcccataggttttggtatgttgtgtttcaattttcatttgtttcaaggaattttcttaatttcttcattgagccactggtcattcagaggcatattgtgtaatttccatgtgtttgtatagtttccaaagttcctcttgttattgacttttgattttattccattgtaatcagagaagatacttgatatgatttcaaagtttttgaatttttaaagatgtattttgtggcctaacatatggtctattcttgagcatgatccatgtggtgaagagaagaatgtatattcttcagctgtcagatgaaacattctataaatatctgttaggtccatttggtctttagtgtagataaggtctgatattttttggttgattttctgtctggatgatctgttcagtgttgaaagtgggctgttgaagtctccaactattgctgcattggttgtctatctctccgtttagctctaataatatttgttttatgtatctgggtgcttcagtgttgggagcatatgtatgtacaattatgacatcctcttgatgaattgatcccttttatatcatgaccttctttgtctgtttttgtcttgaaatttattttatctgatataattatagctattcctgctcttttttggtttccatttgcatggactatcttttttcatccttttcagtgtttatgtgtttttataggtgaaatgtgtttcttatgggtcattgagtcttgatttttttatccgttcagccactctatgtcttttgattagagagtttagtccatttatattcaatgttgttgttgataagcaaggactttactattgccattttgttgtttgttttctggttgttctgtcttccttccttccttccttccttccatccgtccgtccatccgtccgtctgtcttctgtttttggtgaaagcaattttctctggtggtatgttttaactccttgctttatattttttgtgtatctgtggtaggttttttgtttgatgttacaatgaggcctacaaacaacatcttacaacccattatttcaaattgatgacaactgaactcttattgcaaaaacaaacaaacaaggagaaaactaattaaaactctaccctttaactttatcccccctgctttttaactttttgtttctatttatatcttcttatactgtctgtgtcttaaaaagttattgcagttattatttttgagacagtattattttgagacagcctgtcacccaggctggagtgcagcagcatggtctcggctcactgcagcctccacctctggattcagatgattttcctgcctcagcctcccaagtagctgggttacagacgcacaccaccacacctggctaatttttgtatttttaagtagagacggggtttcaccatattggtcaggcggatcttgaactcttgacctcaagtgttccgcctacctcagcctcccaaagtgctgggattacaggtatgagccaccgtgcccagcctaaaagttgttgtagttattatttttgataggttcaactttcagtattcccattcaagatatgagtagtttacacaccacaattatggtgttataatattctgtatttgtctgtatacctaattacaagagagttttgtaccttcagatgatttcttactgctcattaatgtccttttctttcagattaaagaagtccctttaacatttcttgcagaacagatttggtgttgacaaaatccctcagcttttgtttgtcttggaaagtctcaatttctccttcatctttgacgatattttcactggatacaattttctaggataaaaattttttccttcagcacgttaaatagattctgtcactttcttttagcctgtaaggttttcactgagaaatgtgctgccagatatattggagttccaatttatgttattacttttcttttcccttgctgcttttaggattatttctttatctttgacctttgggagtttgattattaaatatcttgaggtagtctcattgggttaaatatgctcaattttctaaagccttcttgtattttaatgttaacatctttctctaggttggaaagtgttattatcttttgaataaactttctactccagtctctctctctacctcttctttaaggccaataactcttagatttgcccttttgaggctttttttctagctaccataggcatgcttcattattttctattctttttcttttgtctcctctgactgtgtattttcaaatagcctgtcttcaagcttactgattctttcttctgcttgatcaattctaatgttgggagactctgatgcattcttcattttttcaattgattttttcagctccggaatttctgcttgattctttttaattatttctatctctttgttaaatttgtctcataacattctgaattctttctctgtcttaccttggatttcactgagcttcttcaaaacagttactttgaattcaccgcttgaaagatcacatatttctgttactccagaattggtcactggtgccttatttagtttatttggagaagtcatgttttcctggatggtcttgaagcttgtgggtgttcatcaatgtcagggcattgaatagttagatatttattctaatatttgcagtctgggtttgtttgtacccaactttctagagaaggattagtaagtattcaaagataattttgagtgttgtaatccagttatttggtcatgcaaccataaatgcattaaggggcaccccaagtccagtaatgtgctgactcttgcagacttgtagaggtactgccttggtggtcttgggagaagaccaaggagatcagggagaattc

SEQ ID NO: 22 - DNA, 5218 bp, Homo sapiens
cttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgaggagtgttccatagtttattgttttcctattatgagaatttaggccaagtgtggtggctcatgcctgtaatcccagcactttgcgaggccgaggtgggcagatcacttgaggtgaggagttcaagaccagcctggccaacatggtgaattatctctactaaaaatacaaaaaaataataataatagccaggcgtggtggcacatgcctgtattcccagctgcttgggaggctgaggcaggagaatggcttgaacctgggaggtggaggttgcagtgagccgagatggtgccactgcattccagcctgggcaacagagcgagactccatctcaaaaaaaaggagacttcatgtgcccccaatttttcactattgttatttgaaaaaatatttttatttgtaagagtttttctttatttaaaatgttcattaataaagttgttggacgggaagcaaaaaaaaaaagttgtttaagataaattcccagaagtgaatttgttagatcaaacacttaaaactttttgttatggaagaattcaaatataaataaaaaattgtgagtaataaaatgaactcacagtttcaacaatgacccac

SEQ ID NO: 23 - DNA, 2523 bp, Homo sapiens
tatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacctgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggtcctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaatagt

SEQ ID NO: 24 - DNA, 3951 bp, Homo sapiens
cggcgcgctcgccggccgaggtgggatcccgaggcctctccagtccgccgagggcgcaccaccggcccgtctcgcccgccgcgccggggaggtggagcacgagcgcacgtgttaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctgtgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaaaaaaaaaaaaaaaaaaaaaaaaaaaaaaa

SEQ ID NO: 25 - DNA, 189271 bp, Homo sapiens
gaattccagctatgctggttatccgcctctggccattttcatgtgagtttgtcctgccctgagggtgttctaggatgaagaaaggatctgggggagttcagcctcagaggacaccccgtgcacccttccctcagcagatatttttcagagccctccgtaccagccactgggctgggcatcagagagagtccagaggtgagaacagtcaggcccagcctccaggggctcagcctggccaggccagcctgtgtcttgttgtacacaggtctgcacaggggggtcttgggagcccagagctggcatgtgggtgggcagtccctgccacagagagtcaggagaagctgcagggagaaggctgcacctgaaccttcaagagaaggcaggtgttccccagacagggacggctagcagggcagctcaggtagaggggacagcccaggcagagccatggaggtgcaggagagccttggcgggtctcgggggctcccagaagagttgagatgcagttctcagtgatggggccactgacgtgcaggttgcactcaccaaggtcctgcgaggcattttcttcctcatcttaggctgggggaagccgaatgcctgccagggtccacagcagagccaagactggagtggaggccatgggactcccagccatgtcctcccatctcctccccggcattccttacactcagtcgaaaggtcttctgacgtcagacctagaagtgtttgagacccatttactctagtccctttgcctcatgggggtggggaaactgacacccagaagggatttagggttggtgtaaggctgcccggctggcagctgaccactgaccacagagatggtgacagcttcccactgtggtgaccagacaggtccctggatcagcccaagctgccacctgtcggcatcccaccccccaactttctgcacttgcagtgacccacagtggcgcctgcacacctcatgacatctcagagccccctccatggcaggggcccctacctgtgaatcgtcttcggcgattctgcctgattgcccttgaacactttcctcatcccctcctgcctgcagaactctctcccttggctgcccgccaactcattgacctggcacccaccactggcccctggatactctcactccagcctcagggagcaaagggttgagctgagaaattggcaagaaaatgtcaaactcttaacacagtttcctgtctctggaaaggctggcagtggaggaaagggatgaaaagccttgaaaaaaatctcattaaaaggctcttcaggcactttggcctgcgaatgagtcttggcaagttctggtttggtgagtttttgcaaaggaatgtggacaagatgagggaaggacttcaaagactgggggacttctagctgggggcagacagcagggaggcggggtgagtgctgtggcctccagttctgctgggcaggctctgccctcatggagcagggatcctgtgtgacccatgggaaggggcaccgagtggcacctctgaggcctctgcagtcagcagctttgacaaggacccagcccctgcttggttgaggtggtgagagtcccaaagccagtggggctaatggctgcatacagtccttacggagggacctttggctttctaatccccgaaggcaaattgcctggcatcttgcaaacgtgacctaaggagacacctctggggtctggcctgtttccatcatgctgtggcacttggttgttcacagcctctccagcccagccaatgagctctgccccgtccagtgtcagttactgaatgagctgtagccctgcaggagctcacagcctcacaaggaaaggaagacacttacacctataactcacggagaatgtgttcagggctgcccgaagtagaaagtactctttctatgaaagtttccaggctatgaaagagggaaggaatcaggaaggggaatgtgaaggatgagcaggtcttaaacccatgcacaggggagaaaaggcaggctgcagagagaatgggcccagagacagggcagggcggagcttgcctaagaacaacaaatgacacattcatctgagcccaagagagatgtagccctgatcaccaggtggaggggtcggggctttacctgtgaggcagcagggagttctcaaggtttgaaacaggatgcagtgctattgtcagggctgtattctagaaccatgagtgaactagggggcccatgagtactggcgaggagggatgccagcttctgcctccctgtccccccagtgatcccccccttcccctccatgtccctacacatgccacgtgaactggcacagaccgagagctggggaggggcctgatgtaggagtccagaaggcgaacagcacgtgggcaggcatcccaggagaccgaggcagcccttttcaagatggagagggacaacacaggctctgcagtcagatatctgaatccaagtcctgcttccatctctttccccgcacctgatgctgggcaaggtactgcaccttcctgagcatcacgggatgcttgcctcagcaagaagtaaggcttggcagataagccctacacatagatggtgctcagtatataccagtctctgcttctcccagcttttccagagccttcagaaatcaccacggaagcagcagagtagacagagccctgggtgagtccaggctgtccctgctgcactaggtgacttgggcaggtatctggcaggtatcttctccacttgcatcgataaaatgagggtctggggtctgattagtaaacttgcttccagtttaagggttctatgactagaccactttcctctcagtccaaggatggcaggaaggtcccatctcctccaaggagggaaggaggagcacgacattatcaagaacttgcctcctgtccttcagattgcttgatgacgtctatttgtatccggcttagagcagccgggtttgtgttgactgctgggtactcagtctttagccggcaaatacctcctgtagctccgaaggaggttgggtgggtgtaacagggccaagaagagctgaggggcactgggggtgcgtggcagttagggttgtttttcttttgtctgtcccttcattgattaatatagcaaaggagagagttttcaaacagtaggcatgtctgggtccaggcaggcaagtgattaatcttagtttgttgctgctgacagctaggagaaagaaataataaaggtttaggggccagtgggagtggggatatgaggaaaggctgctctcccctcatctatcagcagggagcaagtctccacttccttctgccgtccaagcatccccttgttgggttaacatctgagactccagacacctagctccgtggtggttgcttgctcccatgtgtgagccaccagggtggtccctgcaaggccacagtgggacctccctggccattgttgagttccccacacagccccagcatacctgaatacctgacagtggacttagtaggtcactgtattccccagccaggcccctgcagggatgatgaagccttttaagagcaaacttcagggaaggcaggtgtgtgcagctcaggtacagtactgcttgcctcaggacccccacactgctcagcagtggttgcaggggccctgagctcctggccatgtgccccatgactcccccaacagagggagctctgcacagcggtgaagacaatggctctgggtcttggcttaggctcttgaaacccagctccgccacatactaacagggtagtgttgggcaaagggactgaacatctctgagccttggttttctcatctataaaatgggtttcacaggtgtattaatgaagacacaatatatgtgaagtgcttagcatatgctccagcatatagtgagtgctctatcagtggtagctcaaatgtctttattatggacctcagagagccacgggttgttggggaaagagctcggtgtgtcccagtgcattgcaaattgtctgggttcaacctggaagtctccatctgtgcccacatccactgtcctttacgatgatgggttctagattttattggctacagctggaaagaatgctagagaatctcacagaactggagtccaatccaggctcccctcttcctggataacctgtcttgaacctctcacctctcttgcactctgtacgttgtgctttggtgtgaccttggatgaatgagtgaacttctctgacctcctagttgctcatcaggagctggagatgatgaccactcaacaggtatcctttttcatcaccatgctgctgcccctccagctctcctgcccatcttccgaacttgtggtctggcctcctcatctcatagggaagcatgttggcagccagtcaaggtagcagctccaggaataccctaagcagaaatcttggggtttagggaacagaaagagactttttcaattttctggtccaatatcttgaacaagtggagatactgaggcccagaaagaggaagaagcttgcctgcctctggctttcccagcaggcaagctgtttgctagcagcatttgagccagcctgagtcagggcagcaggggtggtgggggaagagggggtctgtctctttgctcttatcgcatggaggatttcatgtcctttcagggctcatggaggaaaaatgaactttctgctcaattagcgtgcttcgtgttttctccttctaaaaggtttaaaagaaatgccacaattagaagccactgctgtaggcaaaacagagactcctcaaacactctttgcagaggactaaatgagaacagtgaactttagaatgtgcagatgccttgcaggataagagagtgcaccattgaggggacactgtgaggaatattagatgacatttccctttattcagaattactgagaaaatgtgccctgctggtggtaaaacattgccaaggacgccaccctcaacattagactggcacctcttctggactctgagcctggtgctttggtgattctggtgcagtgggggtggagagtgtaggaacagccctgggcctatgcccaggagacctgggttcaaatcctagctctgcctctgacaagttacgggatcccaaactagtcaccatgatttgcacccttcctttctgaagggttcagacagaccctagtttgagttctgcatattctctgagccctctgtttactctctagcacagcaagtgtaaatcctgccccgccacctgctctgggctgctgtaacatgtgagtgaggtgatacgggtcagcatgcccagcacagggcctgatatttgggaatagccagctttcacactgtgatagtatgttcaagaagagtagcaaccattgccatcatttttacagataaagaaactggtgttcacattacgtcacagttaatgagtaaagagatgagattgcaacacagctcgaggcctctttctaccttgtggggtctctcggaatagaaacacccccattcctccctagcaggccctgagaagcccagccaatggccaactagttctctggaccaaagctggattttctgacaggacctgtgaccatgagccctgtgcccagcatttctcagacccctttccccaggcagtggtgacatggagaaagcccagagacctgaaaccagaggggctggttctgagccaacagtgtcagcatccatgacccaaatagaagagtctagtttcttctctgggtccagccctcaaggagctgtgaagaaagcgcaactcattgctcctactttacagaagaggaaacagaggctcaaaggggcttaacctgtcttaaggccgtgttgtcagggaggggcagaggctgagcctgcccagctcctggaccactgttctttcctgacccttctcagccatttgctccagctaagcttagaagttctccatttgcactcaggtgctaggctgatgatgctgagactatctggtagcaaactaggaggccaaggccaattcagaggggccagtggcaggcggcctacatacctgatgagagagaagtttaggaagccctatctggccctgggtgtgtgatatagatcaggagagaaggactagggcagtgggagtagaaaggagaggtgtgtggaggtagaattgatgagagggaggaggagtgaggagtcaaggaccacatccagatttcggagcagctgggtggatagtggctctcccggctgcaacgtagacctggaaaagaccaggaaaacagactccctgcagctcagcttcccccttcccaatgctgcctaaaacgcagaggcaagaggtgcctgctctcattctgcctcactctgccagttcacggcccagtgcaccaccccccaacccggcagtgccagacgtgcccgtcaacaggctggggttccctccctggactgctgcgtctcccgtctgagccagggatggagcagtgccctttgttttaccggagctccttggtcttctccagcatctgagcagccgcgattacatttccagccggtttttaattgtctcgtatcagcccacataaatctgcctgtgcggctccgccaccagggaagcattccaactgcccgtctgtctccaggaaacctctcgtgccccgggacagttgccttctgaggcattgggtggtctctccaaatgagaaaaacatttctttccaatcacatttctaacatcttgttaatttgaattatttaacaatatttttgcaaaagccatctgggaatgagttggttggcgacttgggagaaggcatagagggtgctgcagggaaggccacgaggacagctgcagacgtcacatctgctatcagtgaaagggtggctgcatggagaggaaggctgtgatcaggagcccggggattacagcctgaatcccaccattcctaccagccaggaggtcaccagtgagtcacttcccgtctcagcctctgagccctgaggcccagatttgcaatggcagtggaagctcttgtaaactctgagaggctgcacagatgcaggtagggtggtttgcagagcctttgtgctgtaggggcttattttactgatagctgggtaagcgatacaaaggccccacaggaaacatgattggcccttacctagaggcattcggtggggcttgaagcagctaacttcacgtggtaaaatcccagtgttaaggcagggcctgactgttccccagacttttggggagtcagagcccaaagggagttgaatcatccaggtcaagaccctggtggggtcaactgaggcacaggaaggcaagaggaccttcctgaggtcctctggaaggctgctggtagagcccccagaagtcccagctcccaccccagggttatcaccctttggagccccgtaagcactgtatattcttctctcattttctccacagacattgtcagtccttgaggcagatttataaaatcagatgtcaaattttatagcccttgtcttcgctcccgcagttcaaatgctagggctataaaatgaggttttgttgtgtatgcggcacactcgcacgcaggcgcccttgccctctgttggagcagaggctgttccatccgcgggtctatgtctttcacctgctcttctctaggaagctcccctgtgagcagcctccatcctccttccagcacgagtgtttgccacttttaataatgctttgctttttttttttttcttatctttttaaagattatttcacccaagaggaatatcagaaacaattgggtttggcaaagctagcttattccaaatgctttaattaaaaccattttttaattttaattttatttttgccatttcttttggaaaatccacactctgcttatggcctcaggcagcttggagatcaccctgccacgttttaagcacaggctttcagggcggagcttatagacaagtcagcagcatggctttcaccactgagctcttatcgtgccctgggctgtcagctgggtgaggagacaaagacatgtcagcctctgagctcacagtccagacaaggagacaggacagtagggaagtactgtgatgtacagaggtgtggcagaagacaaagcgagggagaaagaaagtaagtctgactaggggcatcttggaagtcttcctggaggaggggccagttgaggaggacttcagatgttaagatgtttgagaggagaaaactggggaagttatggggaagcaacaggacatttaagcaacaaggacatttaagttggagattagaggaaaggccgtatgcagtgtccttcctccctaaggtcccaacttggctagggtagctggctgttcagttttcccttggaagtgacagagcctctctctgttttgtaaaatgtcacccagtttttgtttccagtttgaggtgcataaaatgttacagctcttctagaatttgtctagcagattttccagtttttactagaaaccccccaggaaaaaaatctaggtacataaaccctgggaccttgctttctaaatttgccatctaacatctgattttgaccctcagggttgtagtgtgaaatgatttgtcatctgctaggaacctttcttggctgagcgttctttgggaatgtgtcttttggtctcaacaccccagagggcctggcacatgataggtactcaggaaacgtttggagattatatttgggagaaaagtaatcacaacatgcaaaatgagccatgattgtaataaaatcagattgcaaaggtcagcccagtcggtagccgtatatcacatgcatgtacgcatgtgtgtgggaaaaatataggaaggcactatgccaaattgtgattaaccactgtctgtggtgatgaaatggcaggtttttatcttctttttattttagatttgtgttttctggattttccacagtgaatctcttttataatggtgttttgtttggttttgttttgttttttgagacagagtcccgctctgtcgcccaggctggagtgcaatggcgctatctcggctcactgcaacctctgcctcccaagttcaagcaattctcctgcctcggcctccagagtagctgggattacaggtgtgcatcaccacgcccggctaattgttgtattttttttttttttttttagtagagacggggtttcaccatgttggtcaggctggtctcgaactcctgacgtcaggtgatctgcctgccttggcctcctaaagtcgcccggcctataatagagattttttttttctttaatgaggcagagcaggaagctcattggctatggagttaggaaacgcatttctggttccggctctgtcttgagattttctttgtaacttctctgtgcctcagttatttgggggtactttaattggctcagtagagaaaaagcatagagtatcgtggctaagaaggtagaccacctggagccagaatccctccctggttcagatctcgattctgcgtcttactagctgtatggcctccatttctgcatctgtacaatggggagagtaatagttcctacatctcaggatcgttgtgaggcataaatgcaatcgtggtccaggaccacgattttgtacactctgaagccctagtcagctctctctgactccccacagcaactcactttacgctgaaggagacgggctcagagagatgaggggctcacctgtggccatagcagtgctctacatcccagccctccatcccttcaacaactccccaccacttcccagtctgccagagagcaagccgtgtgcccgtcatttcctcctggcactaaaggcgtatgccccaccgaggccgaacacaacctcgcagggagaaatgcatttgcacggtgccgggcaggcttttcttagctcctggtatagcttgaacaggcgtctgcagagtgttctcagaggcaggaagaatgatgccagtaacagtgattagaaactcgaggcagtgtaggattctgacacatcgatggtaagatgactgaggcaacaaacgcaggagatggtgtgacccggacacccacatttcagactcacagtctccaaatattcgcataactccatgttgagttcagattttcaggctaggaaaatacattttcctgttctgaattgttccaaccctaaccaaaatgtcatctctgaagaagctagggttgcctgttttacttctgtgggatctgtgttttcaggaagcaatcagttcctatagtaagtaactttgtggaactcaattacttgcagacgtgcagggggaacaaaaaacagcaataattaatgtggtcaaacccaagccaaataataaaatgaaagctttgttgtctgtcaaggcagaaatcaatttcattagggagcaaagagccagagatttaattttgagaaaattctccaccctgtggaaagaggttgtcaaaaagctgccagaatgagtgtccaacatgagaggatttgccccccagaaccgtgaccacaaagagctgacagtgacctttgaatgttccatttccaaaccttccaagtgtggccaaagccagtgggcttttgcttcttaaaattcttggacccaactgtacacagtggctcacgcctgtaatcctagcactttgggaggccaaggcaggaggatcacttgagcctaggagttcaataccagcctgggcaacatagtgagacgaggtctctacaaaaaaaaaaaattaattagctgggcatggtggctcacacctgtaatcctaaactactcaggaggctgaggcaggaggatcacttaagcccaggagttagaggttacagtgagttatgaatgtgccactgcactccagcctggacaacaaagcaagacccccatcctttcccaccacagaaaagctctcggccccatgcaccttttagggtgctcaagagatgagtgttactatacctgatgacacttgcatgtcaataagaccctgtctcttgggacttgggaggggctgggagagggggggactcaggaggtccgcagaccccaaaaaggagttcaaccgaagctcaggagtgtctgtgttaatgatggagttgtgtccagccagaaggactgatggccaagctggacagaccccacgggaccctgtttagttgctgactcccgctgtgtgagagatggtgactgcctggggaacgggcagcagaagcgaccaggatgggaaaggacaggaaattctgccccaggggcacagctggaaaagagtagcccgggtcttcctgtctctgagggaccttcacagggcagaagcagtggccttggcctgcaggagctagagctcggagctgggctaatctcagcaagctgtagttagccacatttcagctcaggacatggaagaacttaaccacaggcaaagctgtctgtttggaatgggttgtcttggtggggaatgagctctctggtgatggtggtaagtagcaaagctggacagtaaatattgcggatattacagaggagtttccatcattagatggaactagaatgatgattctcaaacttgaacatgcatcagaatctcttagagggcgagtttacaacagattttgcttgcaaagagatccagggggccacaggcttaacaagtaagtctctgggtactggtggacattctaggacacacttgaataaactctattttttaaaaacctccactccacttccagccctggggctccatggtgtctgtaatgaaggcgagtccttttgtttaatatccttccttcccatgtggtatgagcatctcctatgtgccaagcttcaaaggttgtctcttcatcatgtagatggggaaaccaaggcctgagaaggcagaagccaggaccccaacacccagttctgagctctttacttagctttcagtggacttcagggaacattgtaaactattctctatttcacagatgaagaaactgaggcctagattcccaagaactattgggagtttttccaccaggaaccacggtcattcatataatttgcaaaaggtccttggcagggtttctgggtggttcccagtcaacccgatgcctttgaaattccagggaggaaaaaccaccctcaggttagatgcagtggcctttgagcaggcagatctgtcttaatttgcagttttaaaaggcccctctggattttttttcttcttttcaaataaagtttattgtgtataatgaagatatacaccatgatgttatagaatacatacagatagtaagaaggttactaagagctagatgcagtacctcatgcctataatcccagcgctttgggaggccaaggcaggagaattgcttgagcctgggagttcaagactagcctgggcaacgtcgtgagacctcattactataaaaagttttaaaaattagccaggcatggtggcacacccctgttgtcctagctccttgggtggctgaggcaggaggattccatgagcccaggcatttggggttacagagtgagctgtgattttaccactgctctccagcctgggcgacagagcaaaacaaaaaatgttcctatagtgaaacaaattaacatatccctcaccttacatagttacctttttttttttttttttttgtggctagagcagctaacatctactcatttagtatgaatcccatatgaagtacaatttgtttattacctgtggtcctcgtgttgtgcatcagctctctagacttgttcatcctgcatgtctgctcttttgtaccctctgacctacatctccccatctcctccccaccctgccccaaggacccactgtttttttctccatctctacatatttgaatttgttttagattccacatgtaaatgagatcaatcatacaatatttttcttttctttttttttttttttttttttgagatggagtttcgctcttgttacctaggctggagtgcagtggcgcgatcttggctcactgcctcctgggttcaagtgattctctagcctcagcctcccgagtatctgggattacaggcacccgccaccatgcctggctaatttttgtatttttagtagagacggggtttcatcgtgttgaccaggctggtctcgaactcctgacctcaggtgattcacccaccttggcctcccaaagtgctgggactacagacgtgagccaccacaccaggccatatacaatattttatttctgtatctggcttatttcactgcccctaatgtccttcaggcctattcctgtgtggtgaatgacaagatcttttttagggcggaatagtattctgtcatacatacaccacagtttctttatccattcatccttgacagaccttcagttgttttcatatgctgactgttgtgaatggcgctgctgtaaacatggagtgcagatgtctttacaagatggtgattttacttcctttgggtatatgcccagaaaagggatcgctaggtcatactgtagttctacttctaatttccttacaaagctctttactcttttccataatggctgtaccaatctacattcccaccaacagtgtataagagtttccttttttccgcatcctcgccaacatttgttatcttttgactttttgataatagccattctagtgggtatgaagtgatacctcatagtggttttgacttgcatgtccctgatgattgctgatgttgaacaccttttcatatacctgtcagccatttttttatgtcttctttggagaaatgtctattcaggtcttttgcccattttataatcaggttatttgttttttcactatggagttatgtgagtcctttataaattttggatgttaaccctttatcagatgcatggtttgcaaatattttttcccaatctgtaggctgccatttcatcttattgtctcctttactgtgcaggagcttggatgtagtcccatttatttattttgagcttttgatatgatatccaaaaaaatcattgccaaggccagtgtccaggagcttttcccctgggctgtaagagttttatagtttctatttttatatttaggtcttttatccattttgagttgattttttgtgtgtaatagaagatatgggtccagtttcattcttttgcatgtggaaatctagtttattagcaccatttattgaagggattatcttttctccattgtgtcttcttggtaccctcatcaaaaattagttgacccatatgtgtttggatttgtttctggggtctctattctgtttcactggtctatgtgtctgtttgtatgccagtatcatactgttttgattactatagctttgtaatataatttcaaatcaggaagtgtgatgcccccaactttcttttcttcttcagcattgttttggttactcagggtcttttatggttactcagggtcttttatggttccacatgaattttaggattgtttcttcttttgctgtgaagaatgacattggggttttgataaggattgttgagtttctcatctttactttttttcttaaataaaactaagttagataaggtgctttgtggatagtgagtccgcttcattgctgtgctggtgaacacccttggtcagttggtgaggaggcccccaccagggtgggccaggaagagactggtgagggtgagcactgtgctttagcaagagcaaaggtccatggggtgactcgggatgagaaatgaggagcagggggcattgctgcttccttcccctctcccctccctgcatgtcccctccccctgccacatcccccaccccagcttgtcacaccccattactgcagactctagtctgctggtcttgccagagaatcctccgcaatagaggcatggggcaggggctgtattgcggaaagagagcaaacctctgcccttctctgagcctcagtgtcatctgtaaaatgatgacagggaaccaaatgatctcagagtatctggttggtgtcttgtctccctcagaaatgttgcatttagagcagtgcacacagtagacacttaataaatgccattgaccatctatgaccagtttcctgtttagttcgttttctgttttgttttttgagacagggtctcactctgtcgcccaggctggactgcattggtgtgaacacaactcactacagcctcagcctgccaggctcaagcaatcctcccacctcagcctcccaagtagccgggactacaagcgtgtgccaccatgcccggctaatttttaaattttctacagagatgaggtctcacgatgttgcccaggctggtctcacaaactcctaggctcaagaaattctcccgcattggccttccaaagtgctgggagtgcatgagtcaccacgcccagcttccttttctcttttcatgtggatcctgtgtgcaacagtgtgccttagagactgtggtgaaagaacacttgatgtttcaggaaatcgatctcagggcagtaaacgccttgccccgtgtcatccggccacagagctgggccagaacccaggtatcccaccccagccaggcaggctgcccaactggaggagacgctcctgcagccacatccatggcttctgggctgccaatgcagccgtgaatgacagagcagacgtatgggaaacctagctcagtgctcagcccagacagcacagagccagccaggtgcaccagacacaccagacaggcggccactggtgcagtggctcctgcccagcagatgagaacaagacccacgccaggaccctgagtcctgcactggcgtcagtattttctgaaaggcactgttcttcatttaaaaatttaaaaatgcattaagctggaatctagtgccagccccctgtttcacgtcatgcttatccgaggggcctgccaaagagtgcagatttgtacccaggtgaccaggctccaacgacatcctgcatactcggcggcacctccgcacctggcgagccttgcttccctgctgtccagacctcagactacccttgtgggtgaacagtgaaagctctacttcccagatgaggacctgaagctcagaccaggcacagttcagggcagggactcagatacaggtctgggtggccctgagcctgggctgcgtacagcaccatcctcaggcaccccaaggcccacccccctctccagccctgcctgggtcaaccccagggcgctggccccctttgggctataaaagccattgtgcgctccaagtcctcccctcggcagctggggcttcccccgaggctgccttggcccagcctctgcatggtcctgctctggagtctcctcagatgtggtacatctcccaccatgtgctgctcaggtgggactagggggtcctgtccttggaaacagcctggagccctctggaaccaagccatttggcagattccgctctgtgtcttacacctttacataaggggccaggcgagccgggattcgtcagacgttcacacttcatgtggaggttctcatctgcccctcaccacagcagcaagggtggactctggttattcccatgttgtggatgcagaatttgaggcactggccgtctagcgagtggtgtggctttagcctaggcactgtgggaagctgggctacattattctttgttgtgggggctgtgctgtgcgtcgtagggtatttagcagcgtccctggcctcctcttacttagatgccagtagcacctatgtaccaagacattgcgagtattccccagggaagagggagtgcaaaattgccccaggtaggagccactgctttaaggagcctaagggctcagatagccttgtcctcagtaggaagagatcacccttggcctggattctgtccatcctgttggcacaggcatgagaagcctgcttttgtcattttgctgtccccaagcccaggatccactgtggccagtgtacccacctgtctccctccatgaggggagccattctgccctgccttgttcctcctgctgtggtgctcccacccacactggcatgtccgtcactgacttgagaactcagcactgaagggatcccctccagcttttccagagggagacgctgaggcccagggggaggggacttgcccagccaatgatatcagtgggatcagactttgaacttcctccctttggggaagcgcccagggctgaagagtggagaaaaataatttccgacacacaggccttcatgttcctagaaaagtcctcaattagaggtagaaaaaaaaaaaagagagaaagagaaagagaggaaggaaagaaagaagccctagaccctgtttccctttcctgaagctttggcagcatttcaccatccccctccgcttctgcgtccagccctccttgcagtttccacgtgcacttggctgaggctggtgggaaccctgaggggggactacaaaaggcatccagcgggatccacccaccaagtgtcattgccttcccacttacacacccctggtaatgggaggcttactccctcagtctgagcgctcatcatttaaaaacttcttgtctaataatgtgttggttttctcatgagaaaaattgcccaaaatgggttcattttgacatacctactgctttgtgtgctaaaacgagccttatgcctctacatgttcgccaggagaggcatctgccagctctcctgcctagagatggctttttgtcatgatttactgaaggccttcaccctgggccaccaacttagagcttgagaaatgccctggcgtctcgggtaggctaatcgctgctgatgcgtctattgaaagtctaattatttggttgtaaatcacgtcattttgctcagcagcgtttacattgagacgtttgttcacaataacttggtgtgtgtgtctttggcttgtcactgtgaaggctgctttggaagctgtgggcaggatgcaggtgttggccacgtggcctcctaagctcctttatcccagctgccttgactattagaacatctcagctagaaggagcctccatgccccctgccccacgcctcagacagctggagaaaccagtcacacagtgagatgcacttacatcctggtcccctggcttgggaagccctgatagccttgcatcgtgactgggcaagttgcttctccctcagacccttagtcttctcatctgtgcagtgggtatcttgcatataatgccagccctcccagcttccttgggaggccacaggttagtccagtcatggaccaagggagcatttaaggtcttctcagccatgccagaggtaggccaggccctgtgtgagtgggatctgcctgggctctgggtgagtaattggaccacagaggtggactgttgaaatatttgctgtggagaagccacatctctcacagtgttggggcagtgtctgtaaggaggtagcccaggtccaggctacagctctccatgcatttgggattgttggctttctgctaagatagcagggccctctctttgctgaatgctgtactgaaacagtggcctaattctcttcagagatctctaccgcctctttatctaccacacattgagggagaacggggtcgtgtgtctgcctggcaggcgggcacccactctggctctgtgaagattcaatggacttgtgttcagtctcacttctcgcctcagtggctgcatagtcccaggccagtcacttgagccctctgactctgtttccccacctggaatctgtaggcccatctcttggtgttgctgtgaagaggtacatagagctcttggcagcatggccacagtcggtaagatgggtaatgctgtgcttctcgaatcttctagcactagtgttgctgaagtggctgcatcctgctcgcgggtgtgaggaggagagtttctttagaggcatagacctagcaaaatgtcccacttccctggaggtcaaagaggcggcaggaggagagcagaagttgtgagtcataaaggcactgctttcaagaggcagaattgccatcctcagggtgggggtggggttatggcaggaactacccattttgcaggcttgtaggtgaccacggaggtaccttgccatggtcaccctccatgctggctctcacccacatcacagcaggttagcattagagctgggcctgactcccttcaattccgcacaaacttccctgtttgcctccaccctgttggaagcaagtacatgtctgtgggggtggaagggcccttccccatgccaagcatagaggcagtgctcccagggatcagagtgtgagcactcgctgccctgctccccaaggccaagggacctgcgacacctccctcacctgagaattatctggcaactgatggttgagtgcactttaaatgcacaagctcattctgtctctccttccaacaacctggcccaggaatcttcgcacaatgtaagatttaaatgtttaaaatggcccaacagctttgtgccacattctttggggtaatggaaaataaagtcataagaaagagtaggggtaaaaaatagcaaaataaaatagcccaacaagaagaaaagacgcagccacttagagcctgagtagggaggggcagggccagcgctcacattaccccttcaagaagaccatgattttgcaagggaacttgtctcactttcatgttttatttaggcctgggcaggggacactgggcggctgagtggcctcaggaataagtcctttccaaatcctaagggaagagggctctggtgcattcttccctgtggcctccctgggggagactttctgatttgaaaagcgtgtgcctgtgtactcacctcatagggatgaccctccggaagctccccagtccttcccactctgccagttctcactggctcgtcctgggactgttgctgactggagaaagcatccactgtatccagcctcagagtgggcagcttctccctttgctgggctgcagtcagggacaaggtcgaccagccaccagcctgccctgggaagcttacgtctggaggggaggatgcatggggcctcattgccccggctctgggcagaccctggtgggcgggtggatggatggatggatggatagatgggtggatgggtgatgggcacagtgccccagctgtgtgccaggcatgtatgtgtgcccagaggccagagggggctaaggctcagcctgctgagaaacatcacaatgggctgacaggattcttaacctccagttctcaccaagctgcagggaagccagatcttggggcagaaagaggccaacgggtagctgagcagaggaagatgaggctgtggtgggagcttcagggccttgaatgccaggctttggagttcaacaaacataggttcaaatcctagccctaccatgtcccatgagacacaattttcctgagcctcagttttcccatctgtaaacagtgatcattctaacaacttaaagttgtttgctctacagtttaaatgagataatatgtggcaacagctcagctcagagcccagtacccagtaggggctcttgaagtactgggtgttgttatatctgttttggccatggggagccttagatggttttgacctgagggctaatgttctggggacatctgggtcaggacagcagctccccatgcacctttcaagctaaggtaaaccagaaatcccctctgtgtctggagtcctgtaactgggtcccacacattagtcccaaaggccaatttccatccttctcctgcataaatattatatgcaagtatttttaagtcatttcatcatgaaaagaagcgatttaacataactattacccaggattcttcatgaaatatgcatcaagcaattaggtctaaaagcgagaggtgaggcctcgcaccctgctcggcggccggcagctgcaggctgagtaatgttttattaaagcccgtgattgcgctgcaaggtggggcctgttattagccctgcgtgcccggcacatttgataatcctgatgatgaggaggtgctttttgtgatgataatgagcgatctgaacgcctgtgacagctccagcaccccggcctctgccagccttacaagactcattagacaggtcacccaccagagacacctctcattgtgactttgccctcgcaagatgtcctatcaaaggagatgtggctgatgcaggagcttggcaggcatagcagcctgttgaagctccccgggggcaatgccctccctgaacgacgatggtgctgatgacggtgccgaggtgtggaagcccatgctgccttgaagaagggtgggaggagatgtggctcggagcccggctcagctggctcgggatgcggggccggggctctgggttcacctgcagcctgccttgctgtgcgccttgggccagggtagtgtactctctggcctcagtttcctccacggtaccccaggggagtgagaggtgacccccaggctgcttgcagctcagaatacatgctgcctggagcagccatactccttgcctgatgaacccctctgttctccacagaagtgctcatgcttcctttgctcatgctcgcgtctccttttgtgtgaaggtgggagtcactgaagccactcctggcagctgcttttaaatcttcaactgttagatggcatctccctcatggggaccttaaccaatgagaatgtattgtcacagcatgtctcctggctgtgtgtggacaaggcgtcacctgacccttgcattggtcgaggattggcagatagtctcgggacctcggacccctgggggggcggtcaccaccctgcctctcaggctggggggctccaccaatcagaacatgccatttccaatcctcggcacagccccttgtgtgggtgccacacattgtcttttactcccagcccctctgctgtctctgacctgccgtcagccctgcaccatgggcgctgtggaggcggaagatcagcgtggaggggatgtttgctcagagtctgacgcctctcatccgccccctctgcctggcttcacatggaacactgagggttacatgaggccctctctcaggtctggggagtgctgaggtcaggagcactgactctgggcatctgctgctgataatcactgtgtgactttgggccagacacctcccctttctgcacctcggtgcttcaggacatagagcctggcctacaggaaggattgtccctgaaggcaatcctggccaatgccccagtgaaagcaggactggggatgagggcagcggtggagggaaggtgtgaggctgcttgcagaccccttcctgcaggaagccctcagcgggtaggcagcagattatgttttgcacatgtggaatccaggatctagggctggaagtaccccccagggtcatctagtcagcctccctgtggatgcagcaggagaagggacagagcccagcaaggcacaaggatagcctgagggccagggaacccacggggtgcagtgcttgagcccaggagggtcagcatgtgaacgcgcctttctccctctgcctgagaatggtcaggccacagactagaggttcatggagcccaagtgctggtcccagctctgccttggtctctgagcttcatgaccagtctgccccatcggcacagcctggctcagggtggtaaactcgtgggtgcttacacaggcgagataggagtgtgttgggggtgataaacagcaggctcagacaggcaggagggacttcccggggacgtctagactctcttcagcctggcagctgccccacctcgctatctgtcggcagccaaggtacagaggacattgtgtggcttttagtacttggtggccattctaagcccctaacctgggaacagaggagcttagcttctgcttcggactctgtcagagccattgctgctatcactgtccacttcccttgccagatgccgtagaacaaattcatatgaaatgttgccttcacccatgtgagttactctcctaaccttgaaaatgaaactggcttgttcccctgcagcttcatacctgcacactggcagactcagttcccgccagcggctgtgaccctctgcctgacacctcctccactctgtcccccaggtatagatctgtgagaatcacaaagcctgctggtccagcaccccaaaaacgtaaggccactcagtgcatgcacgcagaggggaatgatgtgcccagggtcataccctcctccctgctgagtgtccctggcacctgcagcccctccttaccagccctgctctctcgcccttccacaccccttctccaggcaaagctgggcatgtggctctgagagctcagctttttaactcttctgctgttttctcagccacacagtttcagcgcattacttaagcaatcacagccctttccaaactggcacagatctgtggtctcttcggcgtggtgggtaggtgagtctttgctggaatggagttttacattcttcttgtaacacacatgccgtttcctttctgcagcctaagcgagtgcgccgcctgcttctcagacgtgtctaggcaattctccgatgaaatgacccttcactgaggagcagaacttgccacaggctctgtaattagaacattgccagccttaaaaaaaatcttgatttaaattccagttctttacaggaattagtctctcttgaaatgtaattggctctcccaacgatttcctttaagctaagggtgacatctctaaatacattattatgagcagacatattgcttagtgctcgcacttcattaagcatttgttctgcccatttaaaaatggtcctggagcccaaattaaggtgttaatagagtgggcacttgtaagcttgggaagcccagtcctgactggaagagatgtgttcaagccctgagagcccctgtgggagcgacagcggctaggggcggagctggagcggaaaggctgcaaaccttcaagtctgcttggagctcaggttgggggagtctgctggaggccgtggagatgggggcaggtgatttgtcagaagctccagctttctacctaagggacagacacccgataaagtggactgtgctttggaaaatctaaagcatccacacgtctggtggcagaatcacagtagaatcataaaaggcgtggaactgagtgggcaggcagaggacaggctggtggaggggtgagggatccagtgtggctgcagccctggtgagagctgggagaggtctgctggggctaggcaaatgctggtgggaggactgtggctttggccctcgtgagctgatgcaggcaggctgcaagggctgtgtgctctgatctctgagaaacccacccactgcttttccttgagcagacttcaggtggctcctcccaagcaggtctgaagccaagcatggtggacatagactgggccctgctccatggcatgctcagaggagccgggatggtggctaagtacctacagttcaggaaggcatgcgtgtcctcagtgccaccagatgaaggaaggagctctgcctgtgggagcctggaaaaccacccagcagaggcaacacaggctggaccttgcaggagacagggtttataaagaagggcaggtagtacagactttctgcccaccttccagtggctaagccaagtcacatggctaactgcctgcaagggaggctgggaaatgtagtccctggctgggtggccccttcccagtgacagtttcctactactgaaagggaaggacagatcacttgccatccctgccacacagtttcctcctctggaaactgggggtgatgacccctgccctacccacttgtcatggcattggggacatgaacacactttgcacctgtcaggcaaggcttaaacagggatatgcactggtaatagaaaagagggactaagttttgttttgttttgttttgttttgttttgttttgttttgttttgttttgttttgtttttctgaagaagtccctagaagcgctcagtgttggaatgctctcttgtagcagtggcggctgctgctggttccgggtcagatgccggaattgggggtgcgcttgggtgcagctgcatttcatctggtcctgggcctcggtcctggcttggagaggtgcagctcacagccacttcatggctgggatcccttctgtcccagacagctgaggagacccttggcctcagcctgagtgtcaggggggtagttctgataactctgtgttttgttcacaggagcaaccagggttttatgcacatgaaactggccaaaaccaaagagaaatacgttctgggtcagaacagccctccgttcgacagtgtcccggaagtcatccactactacaccaccagaaagctacccatcaaaggggctgagcacttgtccctcctctatcccgtggctgtgaggaccctgtgagcggaccagacctgccctgctctgtgacagagcctgagacttggaggtgccagaggccccccaccaaccagcccagccactgttgctggctgtgtcgtttgtgttgtgtgtatggtactagcacaccactgcatgtctctagaatgctgttgccacttacgggggctggagaaggcctggataaagacagaagggcggcaacacaccaccccagcccccacccccaccctctccttgagtttctgtgaattaaaatatttgcaaatccaaagagatgccttccaggatgaacaaaggcagaccagctccgaggggcggggtagggtggggcgggagctccctggctgacatctctttgttctccagctgtctcaaattcacacctctgtacagggcaaagttttcccacaggagcccccctactgatgctgggagccaaatgctggtgctttgagagtcccggaggccccggggttcccgccccgctggtgtgtatatgtgtgtctgtgtgagtgtgtgtgtgagtacagatgtgagaaggtggtcacacacagatgggtaagcccactgatctacttgtagtcactcagtgtaatcattaggctatcttcaaggaatcattgtgcagtcaaaaagaggattcaattatttatgaatagggtgtgtaaataaaatagtcatttaatatatagccttatccttttttgatatactgcagagggtctctgagggggcagttctggtttcactcccagagcaaggcgtgtctcctctgggcttgctgctgtggcaggccccagggaggggagggaggccgaggcctcagctccagccctcagcagctctggacacaagagccgtctgctctgacaactgggctgaggcagtcggtagcactctgggagtcaacccagagctcagagttcaggcttcagcagtggacatagtcaggagcctccagtgttgaccaaaaaaccagtctttccctcctgcagtgggacgtctgtgttgacacccccccaacccctggacacagcacccagctggctacaaagggctctctccccactatctgttagcaccacctgggaggtatttggcatgtagggaaagggagacagagaaggaacgtcatttgcccaaagccacacagctcaccagcagcagagcggttctgcagccaatgctctttcgttggttctgcatggccttgctgtcaccctgcccatggaggagggagaatcctgacctcccagggacatagagccctcagtggtccacactgcttccacacacaagaacacctacacacacacacacacacacacacacagccctcagtggtccacactgcttccacacacaagaacacctacacacacacacacacacacacacagccctcagtggtccacactgcttccacacacaagaacacctacacacgcacacgcacacgcgacctctctcttgcttgccatagcagggtcctcccacacaggccaggcagccccgatgaggctaagagtttctcagctctcctgctttttccacccacccagtagcatgaagatgtggctgccctctcctgaatgagatacaagggttccagagccttcgccaggcaccagctggtctgaatgaactagaagtttgacgactgtcatccctggcccacctgggcagagcacaaggggccgagtttgaatgtcatcagcaggttcagacatcagcgctgctcatgtctttagagactgtttggaggtggttccagctcactgttcacatgcagagacacaggcccggagaaggaggactcgccaaggccacgtgtcgagctgggactgagccctgcccctttaggtagctgcgtggacttcagcggtttgtgcaaagccctgcccttggtgacccgcctttagtgaccagtctgcctcttgggtcttcctcccaggccttgtctggcacgtccacgtggcccagccctcatagagaccacgctggctgtggcctgggtttaatctcttaaagaagccaatcctttccttgcctgtttggcatttcctaaaacatccctcaatgagggaggaaggcagggacaccctggaacgattcgtgctttcctttgggggagtgggaaggtaggtgggaaatgacaagatgagtgaggagttggcacttggccaaacagaggagcctggaccccaaggcttattctcagaggaggcccaagagaggctgaggaagagggggaacaaccctccggcgggggaggagggtgagacctcacactggcaagttcaggtccagccacttcctgaggctgctgggtggggccgcacctcacggtccttccctgtagaccatcttcccgggcacattgctcctcagaaaaggctctgggagggtctcagtggaagctggcagctgtgccctctggccctgacttggcctcttagggtattcctgggaccctccctctgtccctggccttcgtcttcctgaagtttccctgggaggcccaacctcctgcccctctcagggacagaggccagcagaggagccagcttacaggatgggagctgctgaaaagaatttttttcccttaattttatgaacctctccctcttcttcctctaattgtgaccgtttcctgtgtcagcctgtattcatgttttcttggacatctaacaattgaaacagcttttccctttcagaaacactcacattcaggttactggctttggtttggtttttgttttgggtttgttttttttttttttcatctgctgccaattaattggggaaaaaattgagctggatttctttgagagaaaagaaaagctcctgccacacaacgtcgcgccctcggcattttgtctgagaacctccagcactagcggctgtttctgtgtctcccttctttgctggctttattattgaccataatgcctgcccacttgagcaactctgtccttgagcgctgaggagtcaagggcccttctggcagccccccaaacaggatggcgcccacagaaagaaaggaggctttgtaggggaagagggccccaccgcctgccagtcccgtcctgaagtcagaagaatggcccaggctgacaccctctcctggagagaggctcacagcgtagctgttcccaggaaaggggtgcaaagactccgaggcttcaggaggcaggccctgtcctcacagggcggctgtgggccggggcccctctgtggcctgagagtgagcaggagggaaacctgaagcagctacccgcaaggcgtccggtcaacagggtggagctgcaggctccctctgcccattcccagaaccagcggccccctttgtaagatgctgaacacgaagttccggtagctccccagacgctgtctcagaagtggtgatatcattgaccaagggcctggcaaggaccggcagccagggtccccatttgctcttgcagccctagggactgtgcaggtagaagccctgccagcagagcaggctggcgtttggtgttggcccacagacacccgtgaagggtcatggccgaatcaggcagctgtccagccaactgtctctccacccttccagaattggtgatcagcgaagaccaaattcggcaagccatccagagggagtgcagggcgcacagtcttagatgtgggcgcacctcccagaaccccacggggacttgttcacaggcgcgcttgcaggagggcaagccccttggtcctggaacacaggtgccccttggcctttccacctccctccttggggctgtttgcatccctgccaggagccttaaaccagccacctactgctgaagtctcttgtaacattccaaatctatgtgacacactgtataatgatgaatatttaatgtgaagctcttaatatactacaagtgtcttgtttaccatttgtcttttttttttctttcttttttttttgagacagggtctttctctgttacccagcctggggtgcagtggcacagtctccactcactgcagcctttgcctcccaggctctggtgatcctcctacctgagcctcccacatagcggagactacagacatgcaccaccatgcccagctaatttttccatttttagtagagatggggttttgccatgttggccaggctactggtctcactcctgggcttaagggatcctcccaccttggcctcccaaagtcctgggattactggcgggtgcctggccacacagtgtctcctttaaatgcacctccttgagcatgcatgatttttgtttgtttgttttttaatgcagtcatgtgccccaggaatctagctggactgccttctgcttgcaaaagctgagctcttgccatcagcttccaaaggtggattgttaaaggaaaaagcaacctttctgcttcctaattatgaggaagagagaggcctaatgagctcaatggaaataaatgaattcgttcagcagacattcagtgagtacctactggtcctcaggtctggtggatacagtggtgaatgggactcagcccctgccctcaagaagtttccagtgtgtaaaaacaacccaaggagctgtgggatcccagatgagagggaattgaatctgcttgcagcggtcagggaaagttgggccttgggggatggtaggagttcagcagagatcctggcgggctggatggtctatgcagagataacaggtggtagaatcatcagggtgagtccatcagagcctaatgtggtgcagcctgccctggtgggaggtggccagactcctgggactccagaggcctcattccgcagaggcaaatgaacagggcagggcagggagggtctccccaaagatggggagatgctggccacctgtttcctagaggagctgaattcttaaggagagaagggcaggacacgagtcttggcacaaaatctgccattgtttgcctgccaccatcgccatgatgacagcattaggcagcccaggtccacctggaaggtctgcgcccaagcccctcctcacctacacctgaaggggcacagcattccccagcatgttgggggcctgctctggagtgattcctcgacccccccaacccccgcccccgcctccgcaggaacttagttgccactcctccctcccttctccttttcaagaatgtggctgtctgtctccccagctggcccccttcctccccgactctccaggactccagggctttggttcacctcttcccctctcccccacctccccgatacatcccagtgtcccagaatccacacctccaactgtcaggctccctcagagcattgacaccaacacccccatgccccagcatacacatgcacgtgcacacacacacacccggggaacgcctgtgctcggggagggcaaagccctggcacagggtcctggtgacagaaaacattcctgagcttggtcaggaccaaggggccacaggcaatgccagtgctctgccaccgggaatttcctgaagggagggaggaaaggtcacctctagaatgtgttctgcgtggtggtgggtggcggtggtggcgggtatttctctttcagttcaatttaacacacattgagcatgaaacagacagggcaagctggtgaccaggagcaggagactgagcacaagaaaccccttcctcatcagagtccacaggaagcggtgggtcgccagatgccttcatccctgcacagagagccagcaaggcgggccagaaatggaggcccagacagggacagaggcatgctcaaggccacacagcaagtccctctccacatgccttggggtgcttgagggcgaccagctccaagggtcgccttggccagtgcagctctgggaagactagggtagggctgggggattcttctcagagttgatgagccatttctttcctcattggctcccccaagtgggagcatcccaggcctgtagtgactggtgtcatctctggcttgggggacagtttcctaagctgtgatctgaccaggatggcaggaagccaccagtgtggctctagtgccctcgtgtggttttctttagtattgcagccagtcccagggagcagaaatgccacctccaagtcaccctgtcagttacagaaggagaacttctgcaggcccagagaaggaagaggaaggcatgtaaacagataaacggcaggcagtgcggagtgatgaatgatgggtgctccagcagaagagacagtagaagtggcatctgagccaggcctcaacacgcagggagtacgggcatcctaggcaaaggaaacaacttcagcaagagctgggaggctccctctgactcccgatccaagcttttcccactgcagtgtactctaaagtcaagcccattcatgcccactgggaagggaggtcaggccgaatcagaagggctcagtacggaacaattttatgcaatattatttcaaagttactgacttccaattataaaattaatgtgtactttgtggcctggcgcagtggttcacacatgtaatcccagcactttgggaggccaaggcaggcggatcacttgaggtcaggagttcaagaccagcctggccaacatggcgaaaccccgtctctactaaaaatacaaaaattagccagccatggtggctggcgcctataatcccagctactcaggaggctgaggcaggagaatcacttgaccccaggaagcaaagttgcagtgagccgagatcctgccactgcactccagcctgggcaacagagcaagactccatctcaaaaaaaaaaaaaaaaaaaccacacaaagtttgtgcttgtggctgggcacggtggctcacacctgtaatcccaactctttgggaggctaaggcaggcagatcacttgaggccaggaattcaagaccagcctggccaaaatggtgaaaccccatctctactaaaagtacaaaaattagccgggtgtggtaatgggcacctgtagtcccagttacttgggaggctgaggcaggagaatcgcttgaacccaggaggcggaggagccaagatcgggccactgcactccagcctgggtgacagagcaagactctgtctcaaaaaaaaaaatttttttttacttgtattagtaatggaaatttgtatttcaggaaaacataaagaagaaaataaaaattaccctaaactcaaagaacagtacattcacgttctgaagtatcacctcagtctttttctctatgcacatatataattattttaaattaaaattgggctcaagccatgtttacatagttctatagcctccatcttctgcttaacacagtgtcgtgtcccttttcctctgttattaaatctcctacaatatgatctttttttaaatagctgtatcgtattttctacctaaatttttttttttttaaaaaacagagtttcactcttgtcgcccaggctggagtgcagtggcatgatctcagctcactgcaacctctgcctcctaggttcaagcgattctcctgccgcagcctcccaagtagctgggattacaggcgcctaccaccatgcccagctactttttgtatttttagtagacatggggtttcaccatgttggccaggctggtctggaactcctgacctcaaatgatccgcctgccttggcctcccaaagtgctgggattacaggcgtgagccactgcacctggcctctaccttaatttaacttattcaaatttttgtataaccagctctgcagggaattgttcagaaatctttatccatatttctggtttttttgtaaggagaaattaatagacggggcattatgaggtcaaaggttaggtacatcttcaagacttcctgtcctccagagatgcgtcagttcctcttccactgctgtgtccgggagtgcccccacagaaaagctgtcctgttacctttaaagacttttagcaacttggaccttgcctaaaacatgaggcacactgtaagtagcttttctcttcagggacagcatgaattcaggctacccatggggttggacaggagactgggctctgcatgtagggtgagtagttgtccctataagagaagcttttcagggtgcaggactctgagggctaacaccaggatggtcccagcaagccggaacagttgtccttttaccccaagggcaagccccttacctcccattcagtagaccctccctctgcccctgtgagagagccagggtcaggggctggagctggggctggggaaacccagagaagctcagaaggagccctgccctcctcaggtccaggacgcaggtgagcagagaaacagccatcacccagggggaacttagtctaattccgtccctttccagctgtgtgacctgggcaaactgcaaaagcttccgcttcctctgctgcaaagtaacacaaaaccagcagcctcacagggttgctgcaaagattacacgcggtgttgaatgactgcccttagcaaggcttagcgtcatcaaccttcagaggtcagctaggatgagaacaaagtgtgatggcagaggccagtgtagccacaggatttcaaagcaaagagggtctagggtgccagaaaggcttcctgtgggaggcaagaagtggagtctattttataaataaaaaatgctccagcctcactggacatctcctgaagttgagaccacagctcttaagatcttcttcctctccagctggacgtcccagagcagtgctcacagagttctctccatcccctttctcagcatcctctaacatcccatctttctctgttatttaaattaattctaacacactatagttattatctaaataataagcatctgttggccaggagcggtggctcatgcctgtaatcccaacactttgggaggccgaggcaggtggatcacatgaggtcaggagtttgagaccagcctggccaacatggcgaaaccctgtctctactaaaaatagaaaaattagccaggtgtggtggcagatgcctgtaatcccagctacttgggaggctgaggcaggagaatcgcttaaacctgggaggcggaggttgcagtgagccagcatggcaccactgcactccagcttcggcaacagaaaaaaaaaaaagcatctgttttgtttactatttaaataattacatttatttatgtcaatgttgaacctatttattgtcttattgtttaaatgttaaatctgtgcagcagctttattctttaaatattaaacatgtattgtgttcattatctattgtctgtctccaacccctagaacggaaccagaatgcagactccacacaagcagggatctaggacagctgctggcatacagtaggtgctcaataagtatttgttagctgaagtaacaatgataaaagatcctatctgtggcgggtttactctatgtgcgcctcacattgtacatgcattggtctcccacaatgggagtcctgctgtgcagatgagaaactgaagttcaggcctggtgtggtggctcatgtctgtaatccaagtactttgggaggccgaggagggaggagcatttgagttcaggagttcaagaccagcctgggcaacatggagaaaaacccatctctacaaaaaaaaaaaaaaaatacaaaaattagccaggtgtggtactgcacacctgtagtcccagctacttgggaggctgaagtgggaagatcacttgagcccaggaagtggagactgcagtgaactgagatcttgccactgcacttcagcttgggcaacacagggaggccctgtctcaaaataaacaggccgggcatggtggctcacgtctgtaatcccagtattttgggaggccaaggcgggcggatcacttgaggtcaggagttcaagaccagcctggccaacgtggtgaaacccccctctctactaaaaatacaaaaattagccaggcatggtggcaggtgcctatagtcccagttacttgggagactgaggcaggagaagtgcttgaacccaggaggtggaggttgcagtgggcagggatttcgccactgtactccagcctgggcaacagagcgagactccgtctcaaaaaataaaataaaaataaaaaataaacaaaagaagtaaacaaaatatatcagaaaagaaaaactgaggttcagaaaggtgaagcgatgctaggaaaagcagaagttggattcagtggtggaggcccagggggaggtcatagcccagaggtgaatgggatctagagagaaattgcatggtcccttctgccccaaggacaagagagaagggtggcattttgtgtccctgagcaccactgccccctctataccggaaggaggatgagcttccatcgcactggatctgccatcatggggaacctccctcagggtcttggaacatggtcaccaggaaggaccctcatcctgtagatggagatattgaggctggtgtggggctatccagtgacatcactaggaagtggtggatcaaggatgcaaacccaagtattctgaccttgcagcatgctacattgagttcagtgtttcccaactagcctcacctaaggtttacacatggttcttataaaaatacaaattcctaggacctctgcttggagatttttattcaggaggtcttgggtcagccctggaagccgatatttttcacaagttccccatgggtgtcttatgatgagggagctcaggagatactcccctggggtcaaggccaggctgcccaccgccctgcagctcaccatccatctgggcctttgaacaagtgccaggaaaaaggaaagcatcaactatcacactgcgcatttgtggctagctccatcccccaaaacaataggagtggcagagtcccagcctcacctcttactgggtacatagctcagataggtcatgggacttctttgaggacacaaagtatgtgaaaatctgaggaaatgacatatcgtgtggctgcttgggaaacccacacagtattgtgcaactgcttcttgtttcattgacttggcccttggtaggtaaaaatgtatttgtatttcacaagtatgtgtcactcagacaacaagtaaggtgtccctgaccttacccagaggtcaccaatctttctgagctctgggacttatcagggggcataaactttgcctgctggtgtgctgggagaaaaagccggggtaccgaaatgatgatagggaaaaagccacctggtgtcttccttcttatacgctttttctcatcccatgttttttctggaacccaccttatttgaatcctagctttcctttacagatcacctttcccaagtagccttccctgattgcagctggtacaacttccctctcctatcaacactcagagcacttggtatgtgcggctctcaagcaatgctgataattttccttaggactgtttcccctctgagctacaggctcattcacttacacattcctgagccctgtaggaccctgtgtttcaaaccacaggtcactataatgggtcaggatgtcaatttaaagctataatttcccaaaattgcctgagaagaatcagccagggctagcgttaaatatacacaggccaactggcctctctcctggggattctaatttagtctgtcttggaactgattatatatatatatcatatatatcatatttgtgtatatatcgtatgtgtgtatacatcatgtgtgtatatatatcatatgtgtgtatatatcatgtgtgtatatatctatcatatatgtgtgtgtatatatcatatgtgtgtgtgtgtgtatatatatcatatatatatatatatatgttgggtttttttgagttagggtctaactctgtctcccaggctggagtgcagtggtatgatcacagctcactgcagcctcaacctcccagacttaagcaatcctcctgcctcagcctcccaggtagctgggactacagatgtgtgccaccacgcctggctaattattttattgtttatagacagggtctcactgtgttgcccaggctggtctcaaactcaagtgatcctcctgcctcagcctcccaaagttctgggattacagacatgagacagatctattttttaaccagacctctaggacctagaatctaggtcaatgcttttcaatctgtaatgtgcacacagcacacctggtgaacttgttaaataccaatcctggtttactggggccagaattctgcatttctaacacatttctgggtgactcagtgctggtgctgtccctaagtgtatggcccataggtagtttgcccaaattcaagagattcttgtcttcaggcacattggggaagcaagaattgagcactgttgttctcaacctcagcacacctgggaagcttttagactatactaaggttcaggtcccactgcaaaccaattaaatcagaacctctggggcaggggaatggggccggggagtggggcggggggtggctgttgttttgttttcaaagcttcccagatgattctaatgtgaaacagggctaagaatcactgattcagtggggccccaccaccattaaaatgaatgaatgaataaactgaagagaacaaacaatctcccaggctggcagggtaaaccctgggtctctgttatatgttattaatacagatgcacgtgagttgctggatcagagcaggtttggacatgaatgaagcagaaagggagaaggtcctggagttcacagaccagccatggggacagactgcaaggacctgaggtgggggcaagggagggtggggctgacagcactgaggggctctgcagcaggacgtagtgagttcagatggggcagcagtgaccagaagcctctgaactgagccatgcaggaggaacaggacattgttatgaagcaagcaagaccttttaggcacagaggacaaaaaatacccaagcgttgggggacgtgaaaagaatgcagcaagttcagggaagggaacaccaaggggctggctggcccttggccatttggtactgggggtgtgaaggggagtggcagagatagtcactcacagtagctgatactccactgacagcttgcgtaaggctgttttcgtgcacctaagagccaatgaagtctgagggcaccagacaaccttctagaaagcattttttgaggggaggagtggagggtgattaagcaaagatccaccagcaaccttcttatggccctttcccccaggaacccaggccctgccttccaacagctctgctctccacccgcatttcatttcggcaaacatctcctaggcgccctttttgccaagcactgagttggagagccaggaaaaagccagacagctctgccctcatgagctggcggtgggaaagatcacactgtcatgagtgactacaacataggacaggatgtcagaagcgccccaaactttggggcatgggaaggcaggggcaaggacagtcaattttgcctgagatgatcagggaagccttctaggagggagaggaggcaaaaggaccttgaagggctatttggtgaagggctaacatgtatcagtggtgaaagggggaaacaggcttaaggaacacaggatttgcaaaacactgagactgcatatggctaaagcacagaatatagttggggttgaggtggacagactggcaaaagggccaggacaggacagccccgtgcaccgagttaaggagtttggatttactgggggaaccaagagggaaccaagggggaaccattggagatttttaagctgcgggatgacatgatcacagctgggttggaggatatctggcagctgacctagtggttggaggtatggaatgcaggaatgggtggatgaggacagaaatgaagggctaactttaagatggatctggtatccaaaaatagagggttttcatccccaacattcatatgcccaagaagagccaatgaagggcctgggggtttctgacaaggaactaagagctggaggggcagaggactgtgctgtggcctgcagcagcataaaagaagcagactgggctcagctccagacctcagttttcccgttagcctgggattttctgagtctggtgtgccccaattgtgtgtttaatttcagtcttttccttcttgttcaggttttaccgcaggagaataacctctccattctaatctgaaattaattatttatgcttatgaacacgctggatgcctgcctggtttatttatttttcaaataatgcatctgaataggcattcacacaagacagggcaaacataattttgaggcaaaggccctttccaactgttgcccgattaactgttctaagccattgtgtagccttgtccttatcctgcggagtccaaaatttatccctcgcgtactaattagatggcaggtgtctgtgtctgacagtcaagattcgcattatccagccccaccacctgacccttacaatcttatctcctgctgctatgactttctccactgggccaaattccactcatccatcctccaaggcccagttcaaacgtctgctctgtgaagccatctctggttctccctcgaggggggaggtcccctcatgcttctgaatttccagtcttttgttgttgtatccttcatcagacgctaagctccccaggacctggcacgcagtaggttcctcaatggagcgtttgctggaatgggggagggtggtctccagcttcccgagaggcacctaagcacgccagccaaagtggggctgggcagagaccagacccgcttttggagtcagtgtctacaaagtgctctcgggggaagggggcacgcggggaacgtcgcccacccggagccgatccccccaagaacgcttcactcgggtggggttactgcttgggctcgccccaagcacagtgcgcacacttcacacatccgcaagcctcctgaaacgcctctcccctcaggccgacctttctgtttccttcaacgcctcccatctgttgtgtgcgttccagtttccaactcagagtcagaaccatcatttccaaagactcctgcaacagcccgaggacgcatacaaggcatgggttacttttcagacggagatttggggctcagggtccagcgactcacccaaggtcactctcaagaagtatgagggctatgactttgacccaagccttctaactccccgggcagcgctcctcccaagccccccgcaagctgtctgagcttcaaaggaaaaagtttaaaagtgatccatacgtcccaaagcacgcacaaagcgttcttctgtaaactgcggcatgggtcgctgataaaaggtccctctgaaggtttgaagatactcaacaaggctccacagagggtactttggagttttccgcgaaggcgctcgccccgcagaaccgacaaggcccctaaaaccgacaatgcccagacgccccctgcaggcagcgcgctagagaacgcgttggctgtttctggcacgctgaggccaccgtacggcatcaagggtgaagcatggtggctagcggagcccgcatcctgacaggtgtgctggcgtggccctctacctgccccgccgcggcggcctgcggccaggagaagtaggctggcgacatctggcgggccgcgggccgagggaggggaggcggggcggggcggtgtctccctcacgtgaccccaacagcgcccagcgcgtcgcgctgcgccccaacctcggggtcggtcacagtctgcgcctgcgcgggccccggctcgctagccgtcctgcgggacgccggcgctgatgggtgagtgtgggacgagcgtggggaagcaccgggctttcttcgcatgaggttggagggaggggaaacgcgctgaagggcccgctggggcaggctgccgccctgggggcccatccctgtcttctgcgcgctccggctgccctggcccggtccctgcgggccccacccaggcggcgcgggcggaatcagttctgagcctcctcggctccgggctcccccgcctgccgcgggtgtttgtccggctgctgggcgacctttcccgcgaaggcgctgtcccttcattcgggcgcgccctgggctggggaggcacctccctggtgcacaggaaccgcaggggcggggaggagccgggagctgcctgcgcccgggggacagcggggatggcaccgcgcaagggcctctgcgtcccgggagactgggatttcggcctcacctcgggacccctgactgtgaagtgtcagaaacggaagaggacttagtgatcttgtccaaccccctccccgcctttcacaggttggggaaatggacgcctggagaacggtaagttcagctacatagcctggcagtgcttgttctgcgacagcatattgcatcgcgttgtaggaagctcacttgtacaaggattttcggggacgatggtgttggtggtgttagtctccatccattatttggtgttcagtttagctagatggagtatgtcagcacctcaacttcctgcaaaacctttgttttgcatctcacagctctacctagctgatcttaattcccaccttctgtttttctctacttgtaatctctgaaacagaagcccttgaaatgtatagtgaccttgccattttgagccgcctctgcccgtgctttgaaaggattccataggatcaaaaggtgctaggactcttgaggtcccatagtggtttagagcacaggttaccgctttggaactggaatcacccttagcgcatctcaggggaaaacaagctaggagttgactcatctgatctctcgtttggtaaatgaaagcaaactcagatcagtggattttaaaatcagatattgctttgtctttatattggcaagctagtgtcgtaactaggactagacccaggctgatcttgttctgaatgctgactcagacctgctgactagtggaaattcacatcctttgagaattggagtcaccctctccccagtttttgcagagacctttgtgctaggatcatatctgtatcatgctgatccatgtaggctgtaaattataataaggttttagactttacactgttttcttagtcacagaagcttgacacttgtagttgcttgaaaatcaagttcattaactgctcccttatgatgagatagttttacgtagcaaacaagcgtaaagttatggtaaataaattttgcaataaattgcaaagaattatccacattaatgaataaaaatataaagatcagtttagcaaagaaatttaaccatgttcacagtataggtaaacatgcaaaagtctaaactgtactaccaaataatgctgtgcacattatccttctattgctaaattaagaacatattcacaccatcctggtgtgtaggattaaactagagaaaaagctttaaatctgtaaagtccaggagggtttcataacattttttcccccatctaggcctattttttaaatctgagaatctcaatgtacagtaatgttcttaaaatagttggatatggtggtcaataaatggttaacttctgttagctgtagttttctgcttgtttaataacagtccccattctcacacagagtcataaataaactaacctttatttgcaaaatttcagaaagtaatacaagtaacattccagtaaaagtgaacatggacaaaatttttattgttgttcaagtacacaaataacttggcttgtactgtcaaggagcatgtgtaaacagcttgtaggtggtgactttagaatttaaaatattttgtgtgctccgtatgtaaaaataaaatggttttgacattcataaattgtcacaatatcatgtaatcatgtacattaatctaaatattcttgttgatttaacattgtttaattctgaaactgaagaagtgcaaagcattacataggtatcaagcatttctagactaagttttaggacttcaaatattgattaatcttagcttgtaagtgtactaataagagtttttaactcatacctatcagctgaatcagtaaaaagtaaggatgtagtagaactaataattatcaaactcaataccctaacagacttcagtgtctagaacatatcttgaagttaatcatattaagccccaaaactctgtacattaagaaagggagaggagagagggaacagatgatattctggaaccttttttttccctttaatcttatttttactgtgaataacaacactagactcactgaagattttgggacacttactagcaagcatagttaagacaaaatgccaactctcttaaatagtaataagagttttgctcaaagaaaagtacacagccttaaacagtcaagttatgaaataaaggataaaaatagttgtctcacttaagaattacaagaaaataagccaggcacagtggctcacacctgtaatcccagcactttgggaggccaaggcaggctggatcacttgagctcaggagtttgagaccagcctggctaacatagtgaaaccccgtctccactaaaaatacagaaattagccgggtattgtggcatgcctgtaatcccagctacttgggaggctgaggcaggagaatcgcttgaacccaggaggtggaggttgcggtgagccaagattgcgccactgcactccagcctgggcaacagagtgagactctgtctcaaaaaaaaaattttttttttaaactaggtgagcatggtggctgatgcctgtagtcccctttgggaggccaaggctggcagatgatgtgagcccaaggagtttgagaccagcctgggcaacgtagagaaaccctgtctctacaaaacatacaaaaattagctgggcttggtggtgcgggcctgtggtcccaggtactcagatggctgaggtggaaggattgcttgagcccaggaggtcaaggctgcagtaagtgcagtgaactgcgaggtagccactgcattcagcccaggtgacagagcaaaactctgtctcaaaaaaacaaaacaaaactgagaaatagtaagattggtaattcacaagctgctgctttgctaggagtggtaaggttataaattagataaactgataaccctgctcaagaaaaaagggaacataagtacacaggttagaagtaattttttaaaacagcaagtgttggatgggtgcagtggcttgtaaatcccagcactttgggaggccaaggcaggagttcaagaccagcctgggcaacatagcaaggccccctctctgctaaaaaaatgttttttaaaagttagccaagcatggtggcatgcgcctgtggtcctagctactcaggagactgaggccccaggggtccaggctgcagtgagccatgatcgtaccaccgtactccagtctgggtgacagaacaagaccctgtcatttttttttttttttctggatagagtcttgctgtgtcgcccaggctggagtgcagtgctgtgatcttggtttactgcaacctctgcctcccgggttcaagcaattctcctgcctcagcctcccaggtagctgggactacaggtgcgtgccacgatgcctggctaaattttggatttttcgtagagatggggtttcaccgtgttagccaggatggtctcgatttcctgacctcattcatgattcgcctgccttggcctcccaaagtgatgggattacaggcgtgagccaccacacctggccaagatcctgtctttaaaaataaaaataggctgggagcagtggctcatgcctgtcatcccaacactttgggaggccagggtgggaggaacacttgagcccaggagtttgagaccaccgttgacaacatagtgagaccctgtctctacaaaaaaaaaaaaaaaaaaaaaaaaaaaaaaggctatataaattaaaccagaatttttttttttttaaggaaatccagttatcaaaattgactcaagaagagagaacctaacagaacaataacaatggaagaaattgggaacattatcacaaagctatcatcctgccaaactccaggctcagatgtcacaggtgaatgcaattaaacttcaaggaacacatcattttgataagatttaaattgttctacagtatgatgggggtgggggggcggggaatcacatattctttttacaaagccagtggaacattgacactggcacttgatgtgaagatagtattaaaactgaaaacttatctgagtgccaaggcttatgcccataatcccaacactttgggaggctgaggcaggaggattgcttgagccaaggagcttcagaccagcctgggcaacacagagtgaccctgtctctacaaaaaagtgaaaaattagccaggcatggtggcgcacgtgtgtggtcccagctgggagaattgcttaagtctaggagcttgaggctgcagtgagccatgattgtaccactgcactccagcctgggtgacagagtgagaccctgtcttgtaaaagaagaaaaaaaaaatgacaacatgatctgttatgaacagtaatatgaaattttaaaatattagtaaatggaagttagcagtatgatgaaagaatatttcaccacggccaagtagcatttatccacatattgcaagagtgagtaatcaccaagaaatatgctaacataatacaccaaatgaataagtcagaaaagatagaaaagaataataaaatagcttgcccttgttgagttcctactgtacactagactgctgtcctgggcactttacatgttgttagctcagttaattgagctagtctatgaggtagttaatagccacgttttataaagagaataagctatagagtgacttgtcaaaggtcacacagtacatgtgtggtggagctaggatttaagtaggtaattagtaggttccagaggctgtactcttaaatattacactggctgtctccagtgtttgtatgatcatctcaggagctttctaaaagcatttgaccaaagtttaagatagactcttgagttattggcggtgggaaggtgtggaggtgattgaacttcagtacaacaataataaatgtatatttccttcccatgtttgaaaattctctcagtttgacttatcagttgactagaaaaatgaaattcatttttattttatttatttatttatttttgagacagagtcttgctgtgtcgcccaggctgcagtgcagtggtacaatcttggctcactgcaaccttgcctcctgggttccggcaattctcctgcctcagcctcccaagtagctgagatgacaggtgcatgccaccatgcccggctaattttttttttttttgagatggagtttcactcttgttgcccaggctggagtgcaatggcataatctcaactcactgcaacctccgcctccgaggttcaagcaattctcctgcctcagcctcccgaatagctaggattacaggcatgcgccaccacgcctggctaattttgtatttttagtagagacaggatttctccatgttggtcaggctggtcttgaactcctgacctcaggtgatccacccgtctcagcctcccaaagtgctgggattacaggcgtgagccaccgcacccggccacccccggctaatttttgtatttttagtacagatagggttttgccatgttggccaggttggtcttgaacttctgacctcaagtgatctgcctgcttcggcctcccagagtgctgggattacaggtgtaaactactgctcctggcctggaatccatttttaatgggaagcacaatttcatagttaatagttgggggcaggagcttaagttataattgcagctccactaattcttagaatgaatatagattgaagtcttggggtttttggcatgatttgtgagatgaaattatgtgatagcagaaggaaggcctcctgcacttcatgtttacagtagagtcctacagatgggcaggggtagatgataaatagggaggagggatacttgagtggaataaatcatatatgactcagctgatcagtgaacgtttctgtgtcttgatgatttgtttccctgtgtaaacttgaaaactgctaggacctggattatgaacactcagatgacaagaacttcctgtttaaaaccgaaagccaacttaatgataatccctaggagagttcccacaggtgtcaagaaaaatataagaactataattatatatatatgtaattatatatagggattataattataatttattataatcctttattataatttaattttgttcaggaagtatttatcagttcaataagaagaaagaattacacatattataaaagagaaggcaaaattttttgcaagtgatcttttacatggtggaaactaaaacgttcaccaaaaaactgagacatagtaagaattcagtaagttagctggttctaaccttaatacccaagaattgttagttgttttcttatgcaaacgaaaactagttagaaaactgatggaagtaaatagcctatgaataataataatcaggcagggcaaagtggctcatgtctgtaatctcagcactttgggaggctgaggcaggaggatcacttgagcccagaagttgaagaccaggctgggcaacatagtgaaaccccatctcaaaaagaaaaaaaatttaaaaatttaaaatataatagtaaccaaaaaggtgaaatacatagatgtaagaaataatatctatgtgaagaaaattttaatgctttaaggtttgcaaaaagttataagtaaataggaagataccaagttcttgtaaagttaagattcaattttgaaaagatgatcagtatttaaaattaagatagacttgtcatgtcctgtctgtcattccctctggacagctagttaatgacctcctgctgtacggggccttgataccttctatgattgcacttatctccctatagtctaattaatttgcacgtcttatctcccctgacataggtaccggacatacatatgctctttaattttcactctttccatctaaataccactaaaaattcaaagttaataccgttctgaaccttaaatatttatttattgagacagagcttcgcacttgtcacccaggctggagtgcagtggtgcaatctcggctcactgcaacctccgcctcctgggttcaagtgattctcctgcctcagccttcagagtaggtgggacaacaggtgcacaccaccacgcctggctaatttttgtatttttagtggagatggagtttcgccatgttggccagactggtctcgaactcctgacttcaagtgatccacccacctcggcctcccaaaatactgggactaccggcgtgagccactgtgcccggccacccagcctattttaaatatatatgcctcattctgtggatacatcttccaccataaaacaccaacaggattttggggaagagtacaccgaagtttacctgagaaaagtgagagggctagaaaaactgtaataattatctttggagggggaagccctactagatgatgaactatattttgatgctgcaataggttaaaacaggttagtactagagaagaaataccaggctctttgtggaaaagaatggagtgcagaaataaacgcaaacgcccgtgggtatttagattatgctgcaactgatggaaacaaagttcagtcatcagtgatgttggcagtctgttatctttgcctcacttcttaaactgatattccagagatattacagtatacgtgataattcaccataaaaattatggaagggcctgtaatccgagcactttgggaagccgaggcaggcaggtcacttgaggccaggagtttgagaccagcctggccaatgtggcaaaaccttgtctttactaaaaatataaaaattagcagggcatggcagcacacacctatcatcccagctacttgggaggctgaggcaggagaatcacttgaaccaggaaggcagaggttgcagtgagccgagatcatgcctctgcgctctatcctagatgatagagtgagactctctcaaaaaaaaaaaaaaagttgtggaaggaagcctggattacttgttaataattttggagtaatgaagaccttaggagaacatgaaatctagaagttgagatatatttaatattcaaattaagaacttcagtgtataaaaatgatatagacatggaaaaattatttgccacaatttgactaaaatagattcatttgcttcatatctaaaagatactttacaaatcagtaagacaaccaaagtgccagcagaaaaatgggcaacatatatgaaaatgtatagtaaagaagtggtcaatagaaatgaaagatggggaatcatattcaaaaattttaaatggcaggcaaggtggctcactccttacaatcccagcactttgggaagctgaggcattaggatcgcttgaggctaggggttggagaccagcctggctaacataacaagaccccttctctacaaaaaaaaaaaaaaagccgaatgtggtggtggatacctgtagttccagctactcaggaggctgaggcaggagggtcatttgaacctaggagttcgaggttacagtaaaccatgactgtgccactgcatcgtagcctgggcaacagaatgagaccttgtctcaaaaaaaaaaaagtttttaatggcaaaacaattcacatggtataagtacaaggttgcccattgctgcattgtttaaaggcgaaatagaaaaaaacaatacccaaaggaatagttctactataaggacacatgcacagccatgttcactgcagcactattcacagtagcaaagacatggaatcaacctaaatgcccatcagtagtacacgggataaagaagacgtggtacacatacaccatggaatactatgcaggcataaaaagagcaagattgtgccctttgctggaacatggatggagctggaagccattattcttagcatactaactcaggaacagaaaaccaaataccacatgttctcacttacaagtggaagctaaatgatgtgaactcatggacacatagagaggaacaacacacactggggcccataggagggtggagggtgggaggagggagaggatcaggaaagataactaatgggtactaggcttaatacctgggtggcgaaataatctgtacaacaaaccccatggcacaagtttacataacaaacctgcacacgtacctcagaacttaaaattttttgtaaaaggccaggccagtggctcatacctgtaatccctgcactttgggaggccaaggcggacagatcacttgagcccaggagttcaagaccagcctggccaacaagttgataacccatctctacaaaaatagaaaaattagccaggcatggtggcgggcacctgtaatcccagctactcgggaggctgaggcaggagaatcagttgaacccaggaggtggaggttgcagtgagccgagatcgcaccactgcattccagcctgggcaacaaagcaagactctgcctcaaaaaaaaaaaaaaagttaaaaaaaaaggtgagtgggggcaggtttaattagacctttcctctagacactctctggaaggtcttggaattaaaaatgtatatcttttgtatacccactcacacacttggcaagctgaattgtccacagagttttccaaaccttaataatacaaaaccataaaaaaaaacagcaaccataaataggaggtagaataaattgtatacagtgcagtcatttcatagagtactgtgcaaccattctaaacgctcaggtatctctgtgctaatattagattccaaaatgcattgttacatacctcactttttaaacttagtagtgtgtgtgtgtgtttctttttaaaatgacgagtaggttgaagagggcagggaataggggtgggtgagcgtgaacagagtcaggctgattgctgcagggtcccttgcattagttcaggtgagaagagacccgagtaggccagtgagcctggaggagaggctctctgtgtgtttaattggtttccagctttttttctctattcatgtaggttatacacgtttcttctgtgaatttttatttaaatgattttttgttgttactggatctacaaacagcccaactccaaggaatctggcatctctcagtggagcatacaggtgacttcataatctaaccgcattagtaactgccaaaatcggaagtaatttctctctgtttaaaaggcagtgaaacaaattttcagagcaggtttcttcaactgaacaaaatattttggaccttagaggtggtatggctctcctgatcagggagggacagtgaaaggtttgagctctgacactgcccagctctctggatacaaccaagtgactttctttgagtggggagaagtttcctgactccttgtattaccttccttagggtagactttgggcctgcagtgacattagtcctaacttgctcttaggtaaaaagagttcatcttttctaataggaacatgacagcaaagcagctcaaactccaaagaggcgttaggccatagattgtacagatgtctacattttcttaatcatagtctatattcttagaaaaggatatacagatcttagtgtaacatacttaagtaaaatagtttctttcatttgcttcacaagagaaagcaaaaaaatttggctgggcacagtggcttacacctgtaatcccagcaccttgagaggctgaggcagttggatcacttcagcccagaagctcaagaccagcctgggcaacatggtgaaacctcatctctacaaaaaaaatacaaaaattgggccaggcgctgtggcccacacctgtaatcctagcactttgggaggccaaggcgggcggatcacctgaggtcaggagttcaagaccagcctgaccaacacagcaaaaatctgtctttactaaaaatacaaaaactagctgggcatggtggtgcgcacttgtaatcccagctacttgggaggctgaggcagtaaaatcgcttgaacccaggaggcagaggttgcagtgagctgagatcgtgctactacactgcagcctgggcaacagagtgagactccatctaaaagaaaaaaaaaaaaattaaccaggtgtggtggcatgtgcctgtagtcccaggtactcagagggctgaggtgggagaattgcttgaccccaggaggttgaggctgcaggtgagccaagattgcactactgcattccagcctgggcaacagtgagacactgtctcaaaaaaaaagaaaaagaaaaaaatatatatatataatgtagtattgtatatattgtatatatataatgtagtattgttcagagggtcttgggattttcctgagggtcctaaccggcttctctgtcctcatcagctacccatccttctctacctacgttgtgcccctgcagggcatacacaagtaacctccaagaacgcgatgccgctgctcctttagcccaacacctgtgccttagcctctgctgctccattggctaaaatgtgcttcacccttatgtgcatagtgacagttattcagctttcagagccgagcccacgggtcatgtcctgcctgtcattctctccagacagctgattaatgacctcctgctgtatggggccttgataccttccatgatttcatttatctccctgttgtctaattatttgcctgtcttatctcccctgacataggtacctgacatacgtatgctatttaatttttactttgcgtctaaataccattaaaaattcaaaattaatcctacactgaaccttaaacacttctttatttttaataactttatgtctcatcctgtggatacatcttcacttacacattgtgtcttttactattgagcatttgtattcattatttgctgttaaaagcctggctgtgactatcttatggctgaatctttttttttttttttttaaagtagttgtgtgtatatatatatatataaaatttttttttttttttttatcattcttgggtgtttctcgcagagggggatttggcagggtcataggacaatagtggagggaaggtcagcagacaaacaagtgaacaaaggtctctggttttcctaggcagaggaccctgcggccttccgcagtgtttgtgtcgctgggaacttgcgattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatggagtctcctatgtctacttctttctacacagacacagcaacaatctgatttctctgtcttttccccacatttcccccttttctattcgacaaaaccgccatcgtcatcatggcccgttctcaatgagctgttgggtacacctcccagacagggtggcggccgggcagaggggctcctcacttcccagaaggggctgccgggcagaggcgcctcccacctcccggacggggcggctggccgggtgggggctgccccccacctccctcctggacggggcggctggccgggcgatggctgaatctttgtgtacatgttgtgtgaattattttcttaatctgtagtcttagaaggaaaattatggttgtgtgtgtgttccatattcattacacattggtggctctggcagatatacgccccttaggaactaatgctatctgattctttctgtgcctcagctctacgctttctactttgagagtgatcatggttctctttaacatcttttgtcctgagtgttgagcagttcaccacagcatgtgtgtagtatgaggagggaaaaaaaacttaaggaacttggcaattttttgttccaagtgaaagacctagacggttttttgttgtttttattatttcccattgaaactcttaaatatggtttggattgtttccacctcttggctgttgtgaatagtacttctgtgaacgtgggtgtacaaggtctttgagactgcgctttcaattgttttggttatatccccagaagtaggattgttggatcgtatgttcttttttttttttaaagcagggtattactctgtcacccaggctggaacgcagtgacatgaacacagctcactgcagcctgaacttcctgggctcaagaggtccttctccctccaccttcccagtagctggtgtacgccatcatgccccaaaaatttattttgatttttgtagaggcagagtctcactatgttgcccaggctgggcacaaatttgtggcctcatgcaatcctcccaccttggtcttccaaagtgctgggatgacaagtgtgagccactgcgcctgactactatttttaatttttaaattattgttattatttttagaaacaagagtcttgctctgttgcccaggctggagtgcagtggtgcaatcatggctcactgcagccttgacctccctggctcaattgatcctcccacctcagcatcccacatagctggggctacaggcatgtgctaccatgcccagctaatttttaactttttcataggcatgggatctctctatgttgcccacactggtctcaaactcgtgattcaagcaatcctcctgccccagcctcccaaagtgctgggattacaggcataagccaccatgcctggccagtatcttactgttaaggaattaaaatccaattaaaaaatatttagcctcatatacacacacacatacacatatgtgtgtatatatttatatatatttctaatatatagaagtttctatatatttctattatatctaagatacaatatacagttatcatgttatcccccaaataaaggtgatttccaagaccagaactggaaggtgggaattattctgtatgacccagctatttggatctggattttttcagggagaaggaatcagatttagatgactggcaaggaaagatcatgcattttacagaaggaggtgtattataggggtggaactttggcttagttccaatcattttcagcagtatctagtatagccacctcttatcccagggcagcctcacaaagtcattgccatctgtgatatggtagcagggatatgagccctggaatcactcagacttcatttcagaatgctgaccccaccagttactagctgtgccctgaacagaacaaaagagaatactggttttattcatttgtaaaactggaaaaataattgtggagttgttttgagaattcatacatgaaaatagagtgcatggtacatacctgtaggccttccttgcccccatcatcccacacctccaccttccaaggtgcatgttcagtgtcccttacctgtgttcccacaatggttggttatcatagaagctgtcacattggtgtaattgttcaccttggcacattctattagtttgtgaattccttatctttgaatctctagcaacttagcagaggacctagttcatagtaggtaccaaagaagtataaatatgaatagaatgagtgcatgtcttgctgttttatttctcaggggaggaatgtgggcctatttcagcaggacaatagatagataccgtatatagtgtagtcagtaattacgaactagtctagtggctctgaaagtttttggtgttaggactcctttacagtcttaaaaatgattgtgggccccaaacaccctttgtttatgtggactgatattcagggtctttaggaatttaaaattaaaatatgaattttaaggtaatgataaacacattacatgttaacacattttcatgaaaaataacattcatgcctcccatttttttctaatgattttacagtcattagaaaatattttacagttttctaagccttttgcatgtctgacttaagatggagtttcctgtttgctgcattcagtctgttgtgataagtcattttgattaaagtatatgcaaaaaatcaagcctcacatagatatgtagtttgaaaaaggaaaatctcctggactcccaaaaggatctcagggacttccaggggtcttctgaaaatgctttaagaatcactgatctagtctgaaaaggaaagtgtggtgtccagatattagaggatggattagggagaaagcccatgtgtttagctctctataaaacgggtttacccgttgtcatttattatttgtaggttaaaaaaagtccttcatgaaaaagaaagatcttaagcagcatgatggattcagaagctcatgaaaagaggccaccaatactaacatcttcaaaacaagatatatcacctcatattacaaatgttggtgagatgaagcattacttgtgtggctgctgtgcagccttcaacaatgtcgcaatcacatttcccattcagaaggtcctctttcgacaacagctgtatggcatcaaaacccgggatgcaatacttcagttgagaagggatggatttcgaaatttgtatcgtggaatccttcccccattgatgcagaagacaactacgcttgcacttatgtttggtctgtatgaggatttatcctgccttctccacaagcatgtcagtgctccagagtttgcaaccagtggcgtggcggcagtgcttgcagggacaacagaagcaattttcactccactggaaagagttcagacattgcttcaagaccacaagcatcatgacaaatttaccaacacttaccaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatctggtcaatgattttatctgtggaggtctattgggtgccatgttgggattcttgttttttccaattaatgttgtaaaaactcgcatacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaggttatatgaaaaaaccatcagttaagtgccatttatcaactgaatagaccttctaagaagaatgcagtttggcctcttttttttttttttttaaaggaaatcccaatcttattatggaaagccatcaactgggtgtggggagtaggtcagagggttagtgaaagtccaggggatttctcctccaagtcctaccacacaaaggaaagtctcaagcctctattcaccccttctcaatcctcacaaaatagggggttgttcaatattgtcttcaatgataaaaactttgtggttaaaagtttctccttaggactagtgacaaagttaggcttatacttttttttttttttttgaggcagagtcttgctctgttgcccaggctggagtgcagtggcacgatcttggctcactgcaacctccgcctccagggttcaagcaattctcctgccttagcctcctaagtagctgggattacaggcgcccgccaccacgcccagctaattgttttgtatttttagtagagacggggtttcaccatgttggtcaggctggtctcgaacccctgacctcgtgatccacccgcctcggcctcccaaagtgctgggattataggcgtgagccactgtgcccggctacgcccagctaatttttttttttttttgtatttttagtagagatggggtttcatcgtgttagccaggatggtctcgatctcctgacctcgtgatccacccgcctcggcctcccaaagtgctgggattacaggtgtgagccaccgcgcccagccaggcttatacttttaatgaagaccataaaccaagccagaagggcttaaggaagcaagagtccttgggggaaaattcttagcgttctataccccagcatcttaccttagggttaaatctaggtctaaccaggctgtgcaggttgactaagaaggaataatgaaacgacagagtttcatggagaaaccatggagatgtctgaatagctgataagcagttaacacactgacccaagcttggagggaaaccatttccccctccatcctgtgagatctctttcttgctccagtgcaacagttggccacagcatggcaggccttcctgtagggtgcctgacaattccctagatgcctctttaaaatcagaagctgcgcactgccccacccagtcacagccaaagggaaaacataaataaaaggctgtagtctcaggcttgtggttatggaaagagcctggaattgacaggagaggaagcactgccaaagtgaggatcttatttatccttcttgctttccccatctgacactgtggtgggggttgaagccacaggctgctcctcagggatattgtctccagcctttgatagcttcttggcccgctggtatagctcatttaagttaaattctcggatcacattctcctcagagaaggtccatgagacagcccgtcctttcttgtcagtctgtggctgccgcattaccttcttgccaccttggaacaggatcagggtagggagttgattggtgaggggtgatgtgctcactttgtaccgcgtactaacatcagtatagcgtccagcatccaccgtcccaaaatttagccctgtacagttgtacttaagggagaggtcagcatagataggggcaaatgattggcagtcattagaccaattggcaaagaactccacaatccaagtgaccctgttgtcccgttctagttcctcatcaatggttttatcattgaagtacttgatatactcagggcccatatatggggaggggggggtttgcacgtcatcaggaacactatgcagagtgtgatgtaaagtaggcccatgcgaatatccaagcggaagaaaagaattgcgttggccactttactaaacatgaaaatgttgcctatatgttgctccacagtgatggatctgcggttcttcatcatcacaatggcactgagaaacatcaggatctccgcttctctctccggtttcgggcaactcctttggggttccgagtcttctctgaggcccacgttgggcgccgtattattgttgccaaaaagagtgaaactcacagtgaaaccccatctctactaaaaatacaaaaaattagccaggcgtggtggcgggcgcctgtagtcctagctactcgggaggctgaggcaggagaatctctttcttaattggccaaatataagttggtgtcgtaactccaggccacagtgagttatgggcaaagcttttttccttaagcatcaacaaaataggataaaaggttccaataggaaaatacaaggttttttttttttttttttttttttttatcattacctaagagctttaggctaattgcctggtaaatagctgtccatctgatggcctttgacagggaacctaatccccaagataggattctttttcttaaaccaatcttgaaatcgcctgcattgaaacataagtggctgtgaccggccagaggagaaggtcctcaggggccaggggctcctcaggcttcctttgttactccattgcttgcttctctgccctcaggagcagctgcagaggacagtcttcattaagctcaagcatatgacaaaggggcagaacagaaaagaaaaacagcttattaggtataggcttttcatgataaattgcttgtattagttttgaaactaagcacctattggataggcattatactatttctatttagatatggtagatcaaggagctatgaaagttcctgttttgctttctaggtttgaaagttttctgtttgattctgactgtgatcttcaacccttccaaaatgtccttgtgttataatttcacttatttcattgccaaaagatgaagggacttgaatcttgttatagttgttccatcctgttaacaagttttcattttgtgtgtggatcaaattctggttagcttggtttctttgaattactggtgccatctcagcaaaggcctgtggttatttttccccttgagtgggagttggtcatattcaagcatcctgttctcttaaaactctccttttaaaaaataaacacttccataacattttgttttggaagtctattaatgcaatcccacttttttccccctagtttctaaatgttaaagagaggggaaaaaaggctcaggatagttttcacctcacagtgttagctgtcttttattttactcttggaaatagagactccattagggttttgacattttgggaacccagttttaccattgtgtcagtaaaacaataagatagtttgagagcatatgatctaaataaagacatttgaagggttagtttgaattctaaaagtaggtaatagccaaatagcattctcatcccttaacagacaaaaacttatttgtcaaaagaattagaaaaggtgaaaatattttttccagatgaaacttgtgccacttccaattgactaatgaaatacaagagacagactgaaaaagtggattatgcatcttaaaaccctttctgtaaatattatgtagctaaagattgatttccagcatctgacatgacagtaggtttcttgttaaccagtttttcttctttctggataattgcatatgaatatttatacatactgaccaaaataaaggcctcaacttggtagtttactgaaagttcttggacaaatagtccataaaagctgttgacctctaaatgcactatggctggttaaatacagtgaccatccttcttccagctgtaaaggatgaagcgtattaagcattagccaggcagtaataaagctaaatagccatacagcagctctgacaatgttgtgctggatattgcagtttgctttcaaggtgcagatgtaaggatttaaaaaaataataatttggcaccaaataaatatgagtagcatccattggcctattaaatcgagtcaggatttgaagggaattgagtttgagaaatgaataaataaaggcaccttggtgcctgaccccctcaatcatgcgtgtgactttgagcactcacaggtgtgtgcagctactcagcccagggcaggtgggttagcctggggttataccttggccctgggaatagacaccattgggcctttggttttgttgggcttccttttgtctttacactccacacaggtggtagaaatctgagttctaaagcacttttgtgaaatacaagctaagtgagaattctaaagaaaatgctttggtttctgctgtctcaaataagtggcatttaaaaacaattattaataaatatttttaatggttttaactcagtatttttttttatttctttgtcactctttacagcttttgaagaccaaactgcaaatacattaccagggatggttttgtgttgtcctatagacttcttaaatttgacaaaaaatttagcagaacttgtaaccaacagctttgtctgaacttgaagtcaaaatgtgttgttaataagagattctaactattgcttttaccttcagtgtgaactagtgtggtaacaactttgaaaaggcaggccgggtgcggtggctcacgcctgtaatcccagcactttgggaggccaaggcgggtggatcacttgaggtcagaagtttgagaccagcctggccaacatggcgaaaccccatctctactaaaaatacaaaaaactagccgggtatggtggcacatgcctgtgatcccggctacccaggaggctgaggcaggagaatcgcttgaacctgggaggcggaggttgcagtgagccgagattgcgccactgcactccagcctgggcaacagagtgaaactctgtctcaaaaaaaaaaattgaaaaggcaaatgtgattgaatatctgaaaagctttaaaagtggcctttctgttacgtctgtggcacaaatggctcatgagcgcaggacacttatggtcttgtgtcctatacttcatgtgtgatgccaccagaaatgttatggattccgtattgaacacactgagagtggtatgagccctcaggactgcaccacagagtaaacacaaccttgatatggtggcgaatatgtgtgtctttcttgtttcatttgtggttggggacaaaatcgatgtatttgtctaaatagtcgatattcatcttaacatggttggttgtgtaatcaccagctatattgtgaactgtgcaataaaacagaagcgtttgtgtatataattacctttggatacctgaaattcccaagcttggttacaatgtaatgctcagtataaggctgtgcaaacatgtaagggaataatggtggtcgatgggatatatgaaatgggatctagagggcttcgagtgaagccaatcatgttgaacgaacactggttcagtgtagatgaagtagagtgaggcgtatgcagtcataaaatgaagggtggacaggagattacatttgaagaaaggataagcactcagacttggtctcttttaaattaaaatatttcttttctcatgtgcaaatgtatatcaaagacttgaacaggtattctcttgaaatttgaggatttttagtttttaatgctgtctttgcttaatattaaatatgtgttgcctattggctcccaaattgtgtgggagtctctaaatgtttcctcttgaaggttcattattgaaagtggttaagtgcacaatgctatttttgtttgatagtttgagttttatgaccctatgagtttaaatgaaatctgttaaatgtttcagagttaacactttttttttgataatttggaataaagtttgttttttaagcccactctttttggtcttctcttatgcttgagtagttgcttgttactggcacgttccttttttgtggtagtgatagattgatctgttagtctttttattcagaaaacatttagcacactaccttgacttttagcaacttaacctggggatgttgcaggtaaaacattcctttgtctatccatcttatttcgtcaagaggggtttcatataagttttattttccaggtagtttaactgcaaagctttttgtttgtttgtttgacagggtttctattgcctgggctggagtgtagtggcatgatcatggctcactatagccttgacttcctgggctcaagcgatccttccgcctcagcctcctgagtagctgggactacaggtacgtgccaccaagcccagctaatttttgtagagattttcatcatgttgcccaggctggtcttgaactcctgggctcgagcaatctgcccaccttggcctcccaaaagtctgggattacaggcgtgagctactgtgcctggccacattttatttcttaaaggtcttcctcatatttaatacacttctctactgagtttaaactttcttggtttagcttatcagtactttctgttgtaatagagtagcctcatgcaatgtttactcccaagttacatggtctggatgtttgtgcttttcattttttttttttttttatatctacttttgccttcagagctgctcctttctgttgtagctcattggttaggagagtgtgaagttttagccacattgtgaatttgcatgttaagttttaggttgtttcctggctttagagatcattgaggttgcctgataaggacagcaaggtaaaggagcagttgcttctaaaagtcctgttttggattgaaatccatcataaagaataagtgtaatatcctgaacttgtacatttagatttgataaaaagggtgtttaatcatcatctgatgaaatcttttaacccacccatagcagccactgtagagttctagacctccagagtgaggagtaggtgtgaccaggaacagccctgggggatctctgcatagctacagagcactcccaatccccaagagactggttcccatcttaaatctttttatttatttatttacttttttatttagagacggggtttcgctcttgtgaccaggctggaatgcaatggcgtgatctcggctcaccgcaacctccgacctctgggttcaagtgattctcctgcctccgcctcccaagtagctgggattacaggcatgcgccaccacgcctggctaattttgtatttttagtagagatggggtttctccatgttggtcaggctggtctcaaactcctaacctcaggtgatctgcccacctcggcctcccaaagtgctgggattataggcgtgagccaccgcgccggctgccttaaatctatttatctgacgttcccaactaggaaattttttgtccaaatgagtatatgtgattttaaagtagaaatcgaaggtaaaataggatttatctcagttcctatctcccttcaatctattcttcatattgtcaataatttttttttttttttttgagacgtggtctctgtcgccaggctggagtgcagtggtgaaatcttggctcactgcaccctctgcctcctgtgttcaggcgactctcctgcctcagcctccggagtagctgggattgcaggcatccgccatcacacccggctaaatttcgtattttttcagtagagacagttttgcgccaggctggtctcaaactcctgaccttaagtgatccacctgcctcagcctcccaaagtgctgggattacaggcgtgagccgccgtgcccggccatcagtaattttttaaaatgtcacttcaataaatgcttttcctctgccataaagaccaaacatcttgctgtggcctacaggagacaggatgatccagcccttgcctcccttactctcatctctagctaaaactgcgctgctgtctctgcactccagccactggcacttcctgattacttggggcacgctgtactcatcttgctcccagcctctgcccatgcaggtgccctctgccctcagcactgcctttctctacttcatttatagactgctgtccttcagatctcggttgaagtgtcacttccttggggaagctggcttacactctcaggactcggttaggttcccccgtcaggctcttctatgtcaccatgtttctatttttcacagcacttaacctgttttaattacgttgcaaatagtttttgtttgggtctagagaagcatgtattcactagtacattttatttgtgttctctaattattttttctgcagctaaattagaaatttgtagttttccccctaaaaatgcaatgatgttttctctgattttcttgtcacctttcttccaaaaaatccatgtgttcaaagtgcttgcttgcagtttgccccataataaatggttgtttaatccaaatatctgagtagcaaactgagctgatccttctggagaaagtatggttgaatagccgagaccactgagtagtcgcagagaagaccacacatcctgaactcctcagtctggtgtgaggggaggacaatagataactggatgtgtagtgttcccaaacatcactgatcccaaaccattgcttctgcctgccactgccacaaatacagtacgactgccaccccttcatactcagctttaatcctcagcatttcttctggtcctttatgtgcggatgttactcaaagtctacatggaatgccaaaatttccacaggccttgatttttttcacggtgattaagatcagaagtagaacccatcaatactataacactgcactgactttctgatttcaaaagcaactctactctctacaacccacgcaaagtttttccttaccatttggaacccttcaggagttacactgaagccttgataagactgtttcagccaggagtggtggctcacgcctgtaatcccagcactttgggaggctaaggcaggaggattgcttgagtctgggcaacatggcaagactggctctatttttttaaaataacatttttaaaagtatgattaaaagactgtctttctattggctttgctcccccgatggtgagtgtctctaggagtcattatcaataacatcagtgagaatttctttgctggtcacatgaacaccaaattcaatcttcatatcaaccggtgtacagttctgggagcaaccgggatttctccgggatttcaaaaacagcctatgtggcatgactcatgatatccacttcagttttataccaagtgcagcaaagccaaattttgctgcaattagctgttgcctagaccactgtgggtcatgattggcatcatccttgaaaaacatctccactttaggtgggcaaaactcacatccttccttgacaccaggatttctttcgagtgaagaaccagttggtattcttctgcaaaccattcagttggaattatttcacactggggcacaatgaaagctgtctcctcacattttctggtgaaagcagttttaatacctgcttcctgtaacaacagaaaaatgcaactggtaattttatttgagattgcagcttttccttccaggtgattctgactgcatttcctgctgtaatctggtccttagattgcaggacttttcctggcctatctaacaagcaattcatagacctcttttgttttaccctcacatagttttttagcaatgttcagtacctcagctctcactattatcctgagtgggatgaaagttgcacccatgctgagaggcagaaatctctgttgtgaatatttgatacctcttgctttatttatttatttatttatttattgacacagattctcactctgtcacctaggctggagtgcattggcgcaatcttggcccactgcagcctcagcctcccaggctcaagcgatcctcccatctcagcattgccagtagctgggaccacaggtgtgtgccaccattcccagctaaattttgtattttttgtagagacagggtttcaccatgttgcctaggctggtctcaaacttctgagctcaagtgatccacccacctcagcctcccaaagtgctgggattacaggcatgagccaccatgcctggccctgttgcctctttaaaaagccagtcctggcagggcacagtggctcacgcctgcaatctcagcattttgggtggccaaggcaggaggatctattgagtccaggagtttgagagttcaagtccagcctaggcaatatagtaagaccttgtctcaaaaaaaaaaaaaaaaaaaaaacaaccaagaatcaagaatgatgggacacatggatattcagtatcacagcattctggaatatcctatgaaatgaccgaatgaaggtcagccttcatttgttaatgggtcatggaggtcatttaaggaaaaggtaatttttacattgatctcaaagtactgaattgttttagcttgggctgccataacaaagtaccatagactggatgacttaaatcagggttccccaacgcctgggccacggacaggtacccatctgtttggagccaggctgcacagaaggaggtgagcagtgggtaagtgagcattactacctgagctctgcctcctgtcagatcagtggcagcattagattctcattggaatgcaaaccctactgtgaactgcaaatgcaagggatctagattgtgcactccttatgaaaatctaatgcctgatgatctgaggtggaacagtttcatccccaaaccattgtgtcgctccacctatctgtggaaaaattgtcttccataaaaccagtccctggtgccaaaaaggttggggaccactggcttaaacaacatttatttctcatggttctggaggttgggaagtccaagatcaaggagccagcagatttggttcctggtgagggccctctccctggtttgcagagggctgtcctcttgctataccctcacataatggagagaaagttctaatctcagccctttataagtaattataaattagttatctttataagattactaatcccatcatgggcacctctctcatgacctcatctaaccctaattaccacccaaagccctcacctccaaatactatcacattggaagttagggcttcaatatatgaattcagtccacaacattagctgcatgattgatgagactgttctttattctcctttagtttccaaacactgccagcgatcctttactctgagaaatgtctagccaatttgagataaaacacttgtgcatgagtcaggattcagaggtacaggcactccatttttcttatccctcctggcactgtttctgaattgtggagctcaattgaatgaaattgactaggaagagcaagaagaaagtattctttagaatagtttgtcatggagcactgctttgttactgttagaagcaccattaaggcagtgacttgtttacattgttttagggcagctcacctctacagctgctctacctttcatgatcaacagaaataaaacaaactcagttcaggccctctttattaagcaattacttccttctgatgtacactaaaaaatgcatttagttacactgagatgctctcttgtttcagacaatacgaagaaaaataaactatttctctttcaagggtcatcatatctataatgggtggtttatagtaagtagctttcttgtttccttgggcaaaagaagcttcagaattttccttagccctctcagttttctggggaaagtgtggctaaacaaatttccaggttttctcgggctttacctcctcattaaataacagtgatagagttctgagaaggaccaaggtaggaaaaagtgggtacaggtggaaactgaggatctttcatttgtaatctgtgtgtaaaatatggaagtaaagagtaaaaaaaattaggagatgagggcctcagtttgaagatacaattgatttggttttggtttttggtagagatgaggtcttgctatgttggcctaggctggtcacaaactcctggcctcaaatgatcctcccgcctcagcctcccaaagtgctgggattataggcatgagccaccatgcccaaccagcaacagttttatataccttgagaaggttaaagggaagtccaagaagattaaagttttgctgttgctatctagagctcttgaaagcttctgccacttgtgatccaagaacaggaatgcatgttatttgtgtttgggagcaataacacatctatttgagtctatttcaactcgaactagaggaaaacagaatccccaataatttcagtttgtgccttttacagtttttcctcatttattttatttagcgagtttgtgttacacctactcagtgttgtaaaactgccatttcaggacaaatcattttgagttaagaggttctagacttttatggaaaataaagagcactggctgcccgagacaagttccaaagtgaaaatgtaaatgtctcttgatttctccatcgcctcccaggctggattaggccccttctgtgccaagtgataactgtttcttgcctgtctctaactgcatgtttgtactttatctgccaggacaatgtgatctcctcgagggcagggtctgtctttcagatttctatatccacagattagaggttctcataataaatacatttaatgaagtaatcaatctgatctctgatattttctttatcaattattctccttgtttcggaaacccttttaatttcttaagaatttcttttagaaatcatcaagaggaatacataatggataatttcacttacgtgaagttctagaagaggaaaatctgtagcagaaacaaacaaacaaacaaacagtgtttccctctgggaggatgggggcagaggttcacctggaagaggcaggagagaacttgctgggatggtggtagtactctatatgttgacagatgtttgggttacacaggtgtatacatttatataaatttaagtaatgtagagttaatctgtgtacttcattctatgtaaattttacaacaaaagaaaaaaacaaatgttaaactctagtcatgtgaggacttttagaaggatgggtacagatgtcagcaatttaaaatgcatcaaaaattaagatggattaggctgggtgcagtggctcacacctgtaaatcccagcacttggggaggctgagacaggtggatcacctgaggtcaggagttcaagaccagcctggccaacatggtgaaaccccatctctactaaaaatacaaaaattagccaggcgtgatggtgggtgcctgtaaccccagctacttgggaggctgaatcaggagaatcacttgaacctgggagacggaggttgcagtaagccgagattgcaccactgcactccagcctgggcgacgcagagagactccgtctcaaaaaaataaataaaacaagatggactgatggacagagttagttaagggataaaacaagtaaaatattaatggtaaaaccttggtaaacagtgttcactgtaaagttcttttaactttgctgtttggacattttcataataaaatgttgggaaaaaccattagggggtttatcattattgctgaataattgagaaactcagtttagctcttttagtatgctattcttagattgctatgaagttataagataccactgaaatacttgctagaagggaacacaagcctgtggcctagaaatttacttgtcttccccactaatgatgataatatggcagttccctcccactgaggtctggactatcccctcctgaatgtgacagggctggtggctaaaacagaggccaatctttcaaacattctttcctgctgggcgcagtggctcacgcctgtaatcccagcactttgggaggccgaggcggatggatcacgaggtcaggagatcaagaccatcctggctaatacggtgaaaccccgtctctactaaaaatagaaaaaaattagccgggcgtggtggcaggtgcctgtagtcccagctactttggaggctgaggcaggagaatggcttgaacctgggaggcagagcttgcagtgagccaagatcacaccactactctccagcctgggcgacagagcgagactccgtctcaaaacaaacaaacaacaacaacgaaaaagcattctttcctaagactgcccagcaataaggggtctacccacctcctgactagcagggaccaggctactaggaaaattatgattttcctgcaatacactgcaactttaaataaacgccaggaaatctttcttttaattacatacatttattaagtatgcaagaaaaaaactatttaagaataaatgcaatgtgtttagaacaaatctgatgctctgtattttaacttttaaaaagtaaccatttcacaattaaatttggatccttcattttaccccaacaaaaactaaccttttatagagaagaactttaacaagtaatgtcaacaaagcattctaaagtactcataatttaaacaacttgcaaggagacaactgttttttttgagacagggtctggcttgcagtggtgcagtctcggctcactgcaacctctacctcccaggttcaagtgattctcctgcctcagcctcctgagtagctgggactacaggcatgtactaccacgcccagctagttttttgtatctttagtagagacagggttttgccatgttggccaggctggtctcgaactcctgacctcaggtgatctgcctgcctcagcctcccaaagtcctgggattataggcgtgagctacctcacccggctccctggaaataactttttttaaaacactttttaaggctaaaaagtattttgagttgtgtatgctctggttaaagtttcagttgttccttttctggatttattgctattgttagcaacagttgcagctatttacagcttataccagggagtgtatatttctgtagctgctctctcattttgagttaaaagataagctacacagcaccaggtctgttcctgagaaggtaagatcatcttagcttacttaactgcccagtaatgtaaatatcatgtttttgttttattgttttgttttttgagacagagtttcgctcttgttgcccaggctggagtgcaatgccacgatctcggcccactgcaacttccaccccccatgttcaaacaattctcctgccccagcctcccaagtagctgggattacaggcctgcgccactacacctggctaatttttgtacttttagcagagacggggtttcaccatgttggccaggctggtcttgaactcctgacctcaggtgattgcctgccttggcctctcaaagtactacgattacaggcatgagccactgcacccggccaatatcatgttttaatcagggaactcttagctctagttcaagaagtgcaaacctgataatgtactgaaaatgatgtagctgaagggacacattgttcttctatattggcctcaaaaaggtaggaggttctctaaatggacttctgttatctacacagagatccatggcatctgtcatccatggaagatctaaatcttaactgcattttctatatccgtggttctcaaactgtggtccctaagacctacagcatcagtggaggactgattagaaatgcaaaactagggctcccactccagacctacagaatcagaaactctggatggggacccagcaatctattttaacacattttccaggtgattctaatgcacagtaaagtttgagcaccacttttttttgtcctttgccaaaagggaggagcctggaggaaaactcagggacaggcccagtggttgttatacaaaaattggactttcccaagaggggatgtaatgccatgaggtaggggatagcatgaagtctctccaaagaatgagaatgacactccctgactaggacaaagtcagagctaattaatgcggtattacagcagatgcttctaatacttggtgagcagacaatgataaagctcccaagagtacttgcccatggtcttgagtactctcctgtaagggtgggggagtcagggataagaacctgattctaaggcctaaaatggcagtctatttctgcctagtatactcactgggacacactgccaaatagagatgatgcatagacaccagataaccactgatgactgataacgtctctgttaatacatccacctttaccccatcaggaaccaggcaatcctataattatcccattattgtggaaaaaatatatgtggttgaagccacacagatcaagagaaaaactctaagaatatggctctggaagcaataaaccttaaaaagttgtaagcttgcttatctttgccttttaataatattgtggtttttttttcagcctgataatgtagtttttgagatgcagcaaccaactgtacataatgttctataaatgtacatgtgtcgtgatttaaatacctgtttcaagttgatatcctaaatagttattagtttttatttatttatttatttttgagacagcgtctcactctgtcacccaggctggtggcatgatcaaggctgcctcgacctcctgggctcaggtgacccgcccacctcactgcctgcccctccccccaccttccccaatagctggaactacaggctcgtgccaccatgcccagctttttttgtattttttgtagagatggggttttaccacgttgcccaggctgttctcaaactcctgggcccaagcagtctgcccgccttggcctcctaaagtgctaggattacaggcatgagccactgcgtccagcattatttgttttaaaagtagtatatgacagctataaactaaaacagctaagccctagtagataaaggtctagggaataaaagcacttatgtgttacaagacaactctgaaaatgttactggccctatacacataagcggaagcttttcaactttttcacaatgatatcagaataattttacctgattacagaataaagctgcaatacatttctcttacagtatgacacctgtattcacaatgttctacatagtttgtaagcagtaaacattttctcactgaattatcaaagctgtatagcaactgaagttaggctatgaagtcagacagaaccaggtagaagtctaactctgaaactcactaggtatatgactttaggtaaacgaatctaagcctcagtttcttcctctgtaaaatgggaataactgtacccacttcataagaatgccttaaggattaaatagtgcctgtgaagcgctaaggctagtacccaacactagcacacagtaagcaaacagaacagtagcccctaaagatgtccacatccttaatacccagaacttgtatgtaatgttacagggcaagggctaattaaggttgtaaatggaattaagtttgctaatcagctggccttaaaatggagagattatcctgcattatgcagttggcccaatgtaatcacgaaagtcaatgtaagcacggtggcgtacacttgtaatcccagcactttgggaggctgaggcaggaggatcacttgagcccaggagagtttgtgcccagcctgggcaacatagtgagaccctgcctcttcaaaaataaaaaaattaagtactttttaaaaaaaaaagaatatgcttttctgctggttttgaaggaagaaggggcaatgaaccaaggaatgcaggtggcctctagatgctggaaaaggcaaggaaatgaattgtccccttaggctcccagaggaaacacagccccaccaacaccttgattttagcccagtgagatccatttctgacctccagaactggaacataaatttttgttgttttaaataactgagtttatggtaatttgttacagctgcaatagaaaacaaatatacattgttgattccttattattaacgcatggcaaataattatttccctttcaattaaaaatatatttttaaatagcccaaaatatgtcagtcatagagataacgaaatagtgataattagtgctatggttagttaaatcagtttgtctgaatgattaatttcacaaaataatttgaattcaaagggattcactctttttttaatctccaatgatttaccaaaaagagtgtcccaaatatgattatcatactctggtgaatgaaaataatctggtaaaatgaaccatcaatcacactgttaaataatacaacaagaaaatgaaattctagagaacactgaaaaatatcatgttctgagttcttatataagattcagtcactgtaaacagcttgacaaaaagggtaaaaatctatgaatgatgcttcctgttgataatacaattttcactgaataaagaactaattttagaaactctacaaacatattcataccaaataaacttgcaaatggctagaacattagtgaacatatgtgaaagaatgcaatcttagtaaatgtgtttttagtgtaaaatgccaattctacattttagatagtggccttcctaagatgaaatgtccatataccagctgagacccagtttatccctggaggtacaggaagaaatttagaactttaatttttaaaaatcgtatccttttaaactttcgattttcctctgtgtatgttttataatgtacttaacagatcagtacaatagtatacccatcatttatagataatcaaaatttggatcttaaattttttctgatggagagtgcatgattgaaaaagtccagaatgtcactaacaagaattaccaagccactgccattgtcatagccttgtgcttgattttggtctaaaaatgcacatataggtagtttaaacaaaaaatctccagcaattactaaatcaagtttgccatcaaccttttaaacaggttaaccacacacaaaaagtgtgtcaaatgtttcaaagtagcatttatttttaaaaaatcatgttatgaggtagacttatatcacatattcaatgcatttataatataaaggtttttttaaattaaaaccttatatgtttatgtaggtgtgtatatagataaaataaactcatctacaactctacattcatccatttgaaagactcaaaacaattaaaaaggtaaaaagccaattatagttttagaaagcttttgtaattctgaaatgaagaacatttgatctgtccaaaaatttgtgggaaggaggtggttttaatttcagaagttattttactaaattatacattttatagctaattctcaatgaatgtgaatatctttattagaaggtaagtgaaagatactgtaactcttttattactttgtacccatcatgtcaaaatgattacatctaagtaggaccagctacataatttgcaagcccagtacaaaataaaaatgcagtgcccttgttcaaaaagttgagaatttcaagatggctatagcaaagcattaaagtaagcatgaggcctttcaactttttttttattttttttatttttttgaggcaatctcactctgttgcccaggctggagtgcagtggtgtgctctcagcttactgcagtctcaacttcttgggctcaggtgatcctcccacctcagtttcccgagtagctgggactataggtgtatgccgccatgcctggctaattgtgttttcattttttgtagaaatggggtctcattatgttccccaggctggtctcaaactcccgggctcaagcgatcctcctgcctcggcttcccaaagtgctgggattacaggtgtgagctactgcacccagcctacatggaatctttctaagtatgggacactatgtaactgcacatgtacaacctctttaagccagccctgaatctaaatctctttcaactacagctatggaataccaagacgatagttatctttgtcccttgagttcccagtactaaactaggcatataatagggattcaaatgttcgttgaatgaaaaactgagtcttaacttgcagttttccaagtcaatgagaaatgtttgcttgcttatggtcagaacagatcttaccctgatgaatatagtctgttaattataataataaatgatggattcctctattacggaataatctgcacactgcattctgctggcttcatgagagcttcaggccatatatggtgaaggttcatttgattcattcaacaaatatttattgaacaactactctgtgtcaagtcctgtaccaggcactgaggatacaagaataaataaaacagtctctgccctcaaggagcttacagtctagcataagaacttaaaacacctcagaacctactgagaaaagtttctgggtatctagtatattgtctggaatactccaaatttcctaaaaatgtgaatctaaaatttatcaggaaacacagttgggcaattgaagatgcagtgaaatttaaaagaaaattcaaatattcaccctttatgtaaaaaccatgaaatctaaatgagggagaaacttaagaaagctgaaaatctacctattttaaagactttggaccagatttaaactttaaaaattattttattatctctgggtgacattttcatttatagtggcatttatatatacacatacatataggaggtgaatgtgagatatattccttagggcttttgataaaacccatatctttatccctagttcatttacaagagagcagcgtaatggtaactttgagattttccttttgacagtaatttccattatcatttgaatgggagaaattcttaggacatgatttggaatcatttctagaatataaatttcatataatcttattttataatgagacaaaactgtgtctttgtaacaatacgtgataatttaagcctatgttttaatggttattgacaaagtttaatggcatccaaaatactcttatgtctatctgaatttttttcctgtactcttcttttttcttaaaagcatgatagacccctctgcaaatacagagcctttgttgttgctttgctgtactttggtaccttgctgtttattccttagtctagcagcatccttagtttgtagtatatcttacttagttgcaactaaaaaaaattgctagcctaggctttaactgggagtttctattatctagaaggttactgtgaacctttcagaaaagtggaaagcaaccaaaagagctgtctcaaagactgtgtccccccagagtttgtccagctcttactgtagacactctgaacaggcacggttatctcatgtccaaagctcataacagcacattagaagaaagtggggagcctgttagaagcaggcatattgatagtgtgggagaagacatagcaaattacttagcagatattttaaaaattttaaaatccaacagcagtctgaggcaaatgattctgtatacctcagggctgagagaatcactttataacatatttgttatagccctttacattttatgaagtgttttacatacatcagagctggatacttataataatacattatgaatataactttaacttttcatcatgaaaatgtgaattatactgagcatgatgtttaagaagaaggcaggaaggtatactaacatacctgaaatactcacatcaaaaataattacaagttttaaatgttggcacttgagagatatacattagctatccaaaaattcatatgtacggtttccttcaagaccaacacggggtatcactgagtgaattttcacagcgctcagtgactgctggtcattaaatggggatgattgtcatcagtataagtatcacactatttgtcctgctaaatgcaagttaaaagatacttatggatgccactaccacatattctgacaaataagggaaacactaggcttttaaaagattcttagagtgttttccctatattgcactttctagataacacaattttaacaatgatataatgtgatcttggttctagacacagcagtggggaacacatgaatttacctttttcttgttccttttcttaaagtttttagtatagtctcaggaatatagcaaggagaaataacaaaatatacatgtgctttgggcttctgaggaaaaaagaccacccacacacatttttaaaagactaaaatagacgtctcttctgctttagccatttcattttcacaactgaaaataaggaactactatatatttgatgtccctaactcattaaacatagcattgccataaatgcactgttctgcggaaaactttttaaaacagtagaacaatttgtactgcatttactaacaattatactacattaccaattatcatgaattatgaataaaaattactgaataaaattcagagtaaaaaacatcagattagattttactcttaagtgaaatggggctttgaaatgttaagatgtaatttcttccaatactatagcattcctaatgccctttaattccttgattaatattccttgctaactttttgatcatcaccatatctcaaggaggacaaaggttcttttgagtttgctggctgttaatttttaattctcatctgtgtggctcggttttttttcacaatgccgtttatccttaatttttcttttctattttatagctgcttattctgcttgaagttttttagtcaggaatggccagaatgtgtgccctgagtttatgatattctcatggaaattgttaatcttatgaattttttttacatgatacacacggtaagctagctctataattaaaaaaaaaaaatccagaagatactaaacaaataacaggccagcttaccatactttacaaactaaagagcacaatggtaaagcagtaagcacaggctttggacaagacacaaacctgggtttgaatcccagtgctgccactcactgctaactctatgacttaaggcaagtcatttaatctttctgacccactattacctccaaattaaattggggctcattccacctaccctgcaagtttttgtgagggttagtagtgaagtctgtatattatttgacacatgataggtactctatagtaaagaatcattggctgaattttgagttgggtaacttgctggtctagcatctgacatgaactctttccagagttgatacgatttatgaaacttcttttgaatgtcaatatgaccacagtacttggtaggtatttttaaataataacagtttgggtgttttcacctccaaaactaattttattttattttatttttttttttttttttgaggcagagtctcgctctgctggtcaggctagagtacagtggtgcgatctcggctcactgcaacctctgcctcccaggttcatgcgagtctcctgcctcagcctcctgagtagctgggattacaggcacctgccaccacgcttggctatgatttttgtatttttggtagagacagggtttcaccatgttggctaggctgttctcaaactcctgacctcaagtgatccacccacctcagcctcccaaagtgctgggattacaggcatgagccaccatgcccagtctatttttattttttgagacaggatctggctctattgcccagggtggagtgcaatagtgcaatcttggctcactgcagcctctgcctcccaggctcaaaccatcctcccacctcagcctcctgagtagctaggactacaggcgtgtaccaacatgcccatctaatttttgtatttttggtagagatggggtttcgccatgttgcccagactggtctggaactcctgggctcaagtgaacctcccaccttggcctcccaaagtgctgggattacagacgtgagccaccatacccatccctattttctttaaaaaatgtgttttttacaaaatgtatggtaagtatatgtatttactgtgctttgtgataattttctcagtgacaaaaaatttccaattttgttaacatccatggtaaaatgatctaatttcaaaaatttgttctagagccaagatccttataacctctataaatgtgtgtgaatagttagttggcaggtcctacaaagaaatgtcatttttattcatgtattttgggttgtttaaacatttctgtaagatttaaaatacttttcttcttatggctagaattctcagcatctactcccatgcctgcctttctaaaatctattggccagtttaagggtatttacaataatacaacttaaagacaaagtgtccataagtcattatttctaacagacagcataacacagtagaaattgccctgaccaaggaattagaagactggaattcaagtcctaactctgccactaactttgcaggatgaccttaggcaagtcatgtcacttctctcatttgtcaaataatgcaaatgattccattctaaggtattttccacctctaaaattgctttcatttactattattattttttaaataatgaaaacactttctgggaattgtcttaagcccaaatgggtagagaagaattttttttttttttttttttttttgagacagagtctcgctctgtcgcctaggctggagtgcagtggtgcaatctcggcttactgcaccctctgcctcccgggttcaagtgattctcttgcctcagcctcctgggtagctgggattacaggtgagcaccaccacgcccggctaatttttgtatttttagtagagatggcgtttcaccatgttggtcaggctggtctcgaactcctgaccttgtgatccacccacctcggcctcccaaagtgctgggattacaggcatgagccactgcgcctggccgagtagagaagaatttactgctgattaaggttgtgtttttcaacctgcaatcccgagaccctcagaataaagattacttgaggttgctatgaaaaatacagattcctgtcctccccctggctgaatcagaatctcataaggtgaggctcaggtttctgcacttttcacaagctctgtaatggttacagtgcaccctaatgtttgagaaccagtggcctaaagagaatgcaacctaagagggcaaggctagtgcatagcttaaatcgctccagcctttggtaatcccttctaaacacagtaccacccatgtggaggagactgcaaggaagctgttattcaaagtagaacagtcagccttgtgcttgagtcctgctttatgcttgcgtgtttcataacaaaacacaaaggcaagtcttcatatcagcacttagtcttgatatccaagtagctgactactgtacttatgataacagcttgaagaggactgcaactctcccctcacgaatggtgacagagttggcttgtcacacctggctcagggaagaaaaatgagtaaacccctacctctttactcttgattcctcttccaccctaatactgttaacacatcatcctgtgtgattcaaataatctggcagatgaaatacagaaaatctaagtcatattgttcttatcactctatggccagatattatactaatctaattttaaaaatccttttctgtgcaatagaaataaccaaagctcattctgtctcctttcctttctaatgctgttgataggaacaaaatatcaagtaaggatacatgctagagatgttaaattcatacaagtaaagtaaattacaaagagaggtggtaatatttttttctagaatttcacaataaaatccctctcaccatgaaaatctttttataattttaacaggaaacttaaaagacattttgttgcaagactatcttaacaattataagaataatgccattatctgtgctcaatatagataaacataacagtaactttaaaaggccaagtatactcataagtgaggatgaaatttatttttcaacaaccaatatgccaatatccaacttctaggttttattcaattctaatgtcatgggtttctcctaccccagtcaaaactcctgccaaatgtccacaaaattgacaccaaaatcaacaaacacaaagaaagagagggacagggagagggaaagagaaatagagagtgaggaaggaaggaacgtgacaagagctaccatgcaaaatgaccagaagaactggagttcagtggcacagatcagcaggagcagaggaatgctgcaaaagatgatgctgcatagagtctaacttggagatgcctgtatgatgctggatgaccaagtactaaggtcacaagtgtgttcatggacccataagaaccaggatcttgacccaaacttataagatcttctaaaaagaaaatacttcatctaaattgaagcaattcctaagtcaaacaccagaagagttccttatttgatgtaagttgtgcctaaaactttggctgatacaaagaaacccgtccactaaggcaccctgaggcaatctgacaatgtgttggagagaactttgttgtcagtaccacatcattatgagagtacagagaacggatcacccgcaggggactggcttctttgggcaagcagtcaacaagttcactgcactgtttgtcaaatcccaacaagcgaatcccatagccatgtggggaagaaatcattcgtccatcggggctgaagcaaagttctttgatgtaacccctgcctacattggcttcttcaatgtaatgagtcagtcgtagagaacagcgaggtgagacaggtcgcactggagctccttcttggaattcatagacacaagtacactagggggagagaagggagacaaaccaaggttacagagcccaaatagtgctacagatattccttatttttaaaaagctcaacagattgccaaagccacagaatttttacaagaaatcactcagaataatgctatccccctcccaactaacaaaacttgtaggccccctactttcttatcttcataagctgaggttattctgtgttatgatgctttaaagccttttgttccctgaggctgcctgtgacttttgcagtaatacattctcttttctaagggcaacaacaatgttgatattttaaaaattcctggagtacatccaagccctagagtatcttacctcttcccctacacaattcaaaggctcttctcttctctcctttcagttgtggcctctaggaccagtgagatccttggaagactcttgctttccagagtgatgagaatcataaagtcatttaacacctttccccctagtcatcagtatagtcccttcctttcccagagtttcccctggtttttaaaaaaagaaaattatgatactcaattggcttagtaaaatctcacatttagccagcttagctgaaacatttcagacctatgtttattatacaaggggtttttgtttgtttgtttgtttgtttgtttagggtgagatgaaagaggcaagatttaagaagctgggcaaaaactgagctgatgctggcctttaaagtacctcccaccttgctcaaccccagcaggagaggaataagaagagtttggaagggataatgataccatatgaagcaagagaggacagaaacaggagagtcgagaagcaggatctctagcagtatgcccttgaaggcagagactgcagtcagcgatcggcctaagctctgcacacacggcaatggcaatttgtccaatgagccctgttgaaggtggagtgctgctgcctgtacctcctcatcatcactgttgcttgagcaccgaagaagagtggcccagccttttgggtgcagctgtaaggacgtgatgcagtttccgtggtcactctcaccaagaacttcaggggttacgacttcaagactatttcgtggtgaaactcctgagatataagaaaatgaggatgtgggatttgtattatcaaaaaactaaggcagttcatcaaagctttttatttctggcagccacctcccatgccgtcattccttagtctgccccttatgctaccatatgttaaagagcgtggtactccccaatgtatggtgtgtgagttttggcggggtgaaggtgtggggaaagggtataaatagaacaaaagatccaagttcccacagcagtaattgtcactgacctaaggctaaggcatagaagctgactaggggttcttttatttggatcttacatctcagaaagctctttatttaagtaagaaccaaagttatgtgacatgaaaggactctagaaaggtaaaaggtaacaattctcctctcattggtcctggtgctttctggtccagagaaggaaatacttggaagccatgaggattgccttttaagcaaataaaaagatcaggacttaagcacctgcaataacaacactataaacaaaaaataaaatgttggaggtaagaaaggacacctcacataaaggcatgtcaaaacaagggatgggagacattgccaatcatagactctactatgcctcatcatttccttctacctaactcccaatgaaaatgactgctggagtaaggcactgttaataataggaatatgttatatccttcaggtgcgtgaaaaaccactttcatagacactgtaaggaagcaacttagaaatttaatagcaagagaaatatttcaacacttctctgactgtggaaggagttattttgaaggtattgagctccctctgtcagatcctttgtgaattgcttgtcaagcagatgtgttaccttctttctaaagattcccttcagattactacatcattaacagaaacctgtgaagctctaaattacactgctataacaaaactatactgaaataactatttcacatatgattgaactttaacaattttagagaaaaatatactcttattttaagaattaatttggaaaacctataacaaaaccagacaagaaatgcattctaagtaggtggtttgctaactgtgctcctttggggttcctcaggagatggcaaaagtggggaaccacgtgtgggctgaggtgtagatggagtggggaaggctggagggtcaagagcctccctaatttttcttgaaccagagctactttgattttatttgtgctacatctctaagaatccacagcagatttcatgtcaaaaatagagttctaatgctgaaatgcatttgaaagcctctgctctatacagctattatatctgccaaaggatagtgttaacatactctgacatctgaagatccaggatttccaacatttagagcaacttcacctataagccccaccttctcccatgttttccctctcttttcaccctctcattttcctcttcttcccagcctcctcatatatcatctcttccctcattcttaactctctgtggcatagaactgctgtatatttgtgtttgtgtgtttaccactggtcaataacaagcaagcatgttaactattcttcttaaattaagtttctttttcttgtggatggtgtagtcaatcaataaagatttttctcaatgattattagaagccttgacttgtttcccatagcacaagtggaaggagaacaggaagaatctgcaaaagatgtttgtgttacaaatcaaaggaaaaatgttatacttctgggcataaatctttaaatttaagaggaggagcctttaaccttaaagtgaaatatcacagacttcaatatccagaggcaagtggataggccatataggttagaaagagctcttaaaccattctactgacataagtagccatgcaagataaccagcatctactaggcaaagccacccagtgaaaacacaaattagaagtctaagatttagtctctgcccaaaataacaaggtagagaaatgtctatctccaaaagtgacccaaaatgacaaaaaaaaaagcaagccatctctggctcttaatactcagttcacaaagagaagaataaacaatgaatggtataagagcttagacgtcagttagtatgaagaggaacagtatgtggaatttgtataggcagaaaccatttcaactgggggggtgtggtggaaggtatagggcagagcaactagttctgccagaatggctaggaaaaaactgggaaatacagagaggagccagatggtagctcactttatcctacaaacccttggaagctgtcaggcattgcacagacaaggaaatggcagagcaaaaagtctgagggtaaccaggtgactttcacaattacctgaaaattcatgacttatatttatacagagctttcacgtgcataatctcacttaattttcacaacaatcttgattgaaatctatatttctgaactacttcctctccaaactagaccaaactaagtccagctaataaaaccaaagctcaagttctattaagatttaactcaagatattcaaccccagggactctcggttagctttttgaagatgatgactgagggataaatcacctcatctccattgcttttatttttatggattaaaaccataaaactggttttaatcaatcaataattaatcagattggcataatctgttgttacaagattataaaatccaacttttaacctaccttctctttgagaggctcgtgacatgtgtttctcagaagaattagaatcactatgatgacaaggtgagccagaaactctaggaccagatgaacttgatgaagtggtcaaatcttaaaaatataaaaaattctgacaataaacctagcataactctggtagtggctcttaactttttaattatctactcgaaccatagttttaaaattttgaaaaaatgctcatatatcactggcctataagactgaggaaggcaagacagctctttgaagtgttctaagatctagtccctttctgaatcttttatatcaaagacttgactatgtgaaataaaaatgaaaaaccaaataatcataggagcgtctttggatcctcatgatttctgtactaaaatggaacccaaaaattccatgaaaatgaaaactaagctcttaagcctattgttttatgttaaaatagggtccaaacaacaggcccattaccagaaacatgaagagattcttctttaaagtataccaaaaacttccattatcattcttgaaattacgtgaatagtctttttttttgagacaaggatcttgctatgttgcccaggctggactcctaattcctgggttcaagtgatcctcctgcctcagcctcagcctcctgagtagctgggcctaaaggcatgcaccactgtgccaagtttatgtgaatactgtgaaatgtgacataaagtttacattgaaaaaaataaaatgagtatcaggtagtggagtctgatatattactccaaatagcagtgtctatttcatcatcacattttgctagtggtcccatacctatgttaagaattcttactagtctaatttcctgtaatgttatttagtatcagaattaccattagaaaactgaaaaccttgttggtttttgagttgaaataggccaactagacattcaaaatcactatttctcactaagttagagttgcttatcatgtttaacttaaaaggcaaatttgaatctcaaaggattatactcgtatatttatgaaatcccttgtttgcaagtaagttggtaaaacttaaatttctacttttgacagttatgccaggcactgcagtacaatgatgtctgtactttcccaaaggaattttcagaagtggtcctgtgcacaaggagaaagattccaaccttttttttcatttccttttttttggacacagggtctttctctgttgcccagggtggagggcagtggggcacaatcatggctcactgctgcctcaacctgccaggctcaggtgatcctcctgccccagcttcctgagtagatgggactacagatgcatgctagcatatctggctaatttttgtgtttttcgtagagacagggtttcaccatgttgcccaggctggtcacaaactcctgggctcaagcgatctgctcacctcagtctctcaaagtgctaggattacaaacgtgagccactgcacctggctaaatttttaagttatttgtagagatgaggtcttcctatgttgcccaggctacccttgagttcaactcctgggctcaagcgatcctcccaccttggcctcccaaagtgatgggattacaggtgtgagcccccgcacctggccccaaccattcaaagctgccttttaatagcaatttattagcattctatgttccaaatgcttaagtcttttttcccctggatttttgtttataatgtaaatgatgggtatgtccccacaccagtcccctctttcccaaaggtagatgaaatatagtcttttttaaatcacataatgttgataaaatacaatacgtacatttttctgaaccctaaattctcttaagtctaacaaaatcagcaatgggagaagagacagagttttagcaaaagagcgtttagagagtaatgagataagatggcaccagctacctgtgtctggacatctgtaagtctaggatacagataaaactaaaactctatattgaccataatttaataaaagctctgcttgattccagaaggacttaagaccttgtgccatcactaatttttgagatagtgatgattcaaaattactgatgaaaagatcctgtggctagcataaagctaaaagaaaatactttagggtcagcagttattcctcctagtccatttgtgattcagaggtacatatgaatgatatgtcagagatacatacaaatcattatacttgcttagataaaaacccatcaatgagctttctaaagaatgccttttaaaaaactgtcttcccttttcctgctatcattttcagaaaagaaacctataccatctctatgtttgagattctcgagaaaaatctttttgaccaaaaaagaaaagcttacctgaacttgaagtagttcttcttgctcttaaaatgggatagctgcctacttctaaagacttagttaagtcaaggtcatgcaaaattaagagatatccagaggacgttgaaatcaacattttggaacaatctggtgttaacctcattcgcatgagaaaacgtgtgtgaaagaatttcttatgtggacacccatcttctgtatacctacaggagaaaccaagccaacaaaatctagagttatcataaatataacggttcagtaataatcatattttttgcccttcaaaataaaatgtagggaggatgagaagagcttggtcaatgggctcaaaattacaattaggaggaataagttctagggtattaatattgcacagtagggtgatgacggttaatagtaagatacagtatattataaaatagctagaagagcgactgttacatgtccttaccacaaaggaatgataagtgcatgctaatactgatttgctcattatacaacatatatgtgtcaagacatcaaattgtaccctgtaaatatgtgcagttacaatgtgtcaattaaaaaatatttgaggccaggcatggtggctcatgcctgtaaccccagcactttgagagaccaaggcaggaggattgcttgagcctaggagttcaagaccatcctgggcaagatggtgaccccatctctacaaaaatttaaaaaattaaaataaattagctgagtgtggtggtgtgcactcatagttccaactactcaggaggctgaggtgggaggatcacgcgagcctgggagtttgaggctgcagtgagctatgatcacacgactgcactccagcctgggtgacagacagacagaccctgtctctattcaaaaaaaaaaaaattgaaacttcaaaaatgagatgtctttccaataaattttactttttatgttaataattattatttaaaataatacatgttgttttaatcaattgtggactaataatattgtaatgatcattaaatccagaagaaatgtaacactaatagccctgtggtcacagaaaacaatttttaaaattaatgtcagtttacgtgcatatttttgatgccaataagaatgatcagtaggctaggggtggtggctcacacctgtaatcccaacactttgggaggctgaggcgtgaggacagatggagcccaggatttcaagaccaaccagggcaacatagcaagaccctgtctctacaaaaaataaaaagttagctggagactgaggtgcgaggatggtttgagcctgggatgtggacggtgcagtgagccatgattgcgccactgcacaccagcctgagcatataacaggatataattctatgagaaaatataatgaaaatgagtaccagaagaaaaagttgtaaaacttccagctgttaaaaaaaatagaatttacagtcaatgtatattgagatttacatacatgcttaacaatctttttgctcatcattccttcgttcatctccaaaattccttttttgatcctttctttctgaagtatatccctcagaatttttttttttttttttttgagatggagttttgctcttgtcgcccaggctggagtgcaatggtactgtctcagctcgctgcaacctctgcctctcgggttcaagcgattctcctgcctcagcctcccaagtagctgggattacaggcacgcaccaccacacccatgcctgggattacaggcatgaaccaccatgcccggccagaattttttaaagttagactttgttgaggtaaatgctctcgctttttattgttctgaaaatcttttttttttttttttgagacggagtttcactcttgttgcccaggctagagtgcaatggcgcgatcttggcttactgtgaactccgcctcctgggtttaagcgattctcctgcctcagcctttaaaaaaaataaaattttttaatggtgtacatgatgtttcaaatatgtatatattgtggaatagctaaatcaagctaatttatatatatatatatatatatatatatatatatataacctcacatacttaacatttatgatgataacacttaaaatctacttttaacaaatttcaattatatataataacaacagtaaattgtcattaacagtggtcatcatgttgtacaatatacatctcccaagtagctgggattacaggcacctgccaccacatccagctaatttttcacatttttagtagagacggggtttcaccatgttggccaggctggtctcaaaatcctgacctctggtgatccaccgccttggcctacaaaagtgctgggattataggcgtgagccaccatgcccagcctgttctgaaaatctttatttcactcttttaagagactgggtctccctctgttgcccaggctggggtgcagtggcataatcatagctcactataacctcaaattcccaggctcaaggaatcttcccacttcagccttccgagtagctggaactacaggtgtgcaccaccactcctggctaatttttaaattttctgtagagatggggtcttgctgtgttgcccaggctagtcttggaactcctggtctcaagtgatcctcccacttcagcctctcaaagtgctgagattataagtatgagccactatgcccagctcaactcatcttattgaataaaggtttagcttagcatataattttaggtcgttgtttccttctgaatatttaggataattttccacagagttctattttccattgttactatttgtgagtctgctattagtctgactattactttgcgtaatttatcttttttcccccctctggtgaatcttctctctgtctttagagtactgcaatttcactggtatatgtaaatttggatctctttttatttatctttactgggattcatttgactttccaagtcttaagattcgtattattcatatattctgaaagtttctcagtcattattccaatattgcctctcactgattttccctattcttttagagctccaaatatatgtatgaaacattcatgtttgactctccttttcttataacttgcttctttatattttctatcttttcatttcagtatctttttcatattatattctgggtaacttttcaatatctattttcatatatatttatttatttatttatttattttgagacagagtcttactctgtcgcccaatgcagtggcatgatcttggctcactgcaacctctgcctcccaggttcaagcgattctcctgcctcagcctcccgagtaaccgggattacaagcgcctgccatcacgcccagctaatttttgtatttttagtaaagatggggttttaccatgttgaccaggctggtctcaaactcctgacctcaagtgatccacccgcctcggcctcccaaagtgctgggattacaggtgtgagccactgtgcccaggcagtttatgccctttattttaaaatttgcttattggctaggtgcagtggctcatgcctgtaatcccagcactttgggaggccgaggtgggacgatcacttgagccagaagttagagaccaacacgggcaacataatgagacactgtctctatgaaaaaatgcaaaagtagccaggcagagtgtcacacctgtggtcccaggtacttgagaggctgaggtaggaggatggcttgagcccaggaggacagggtggtagtaaactatgattgtgccactatattccactctgtcgctcaagctggagtgcagtggcacaatctcggttcactgcagcctcctcctcccaggttcaagcaattctcctgccttagcctcccaagtagctgggattacaggtgtgtggcaccacacccggctactctttgtattttcagtacagacaaggtttcaccatgttggccaggctggtctcgaactcctgatctcaaatgatccacccgccttggcctcccaaagtgctggaattagaggcatgagctaccgcaccaggcctaaaaaaatgagtttttttaatggtgtacatgatatttgaaatatgtatatattgtggaatggctaaatcaagctaatttatatatatatatatatatatatatatatatatatatatatatatatatatatataaaatatatcctcacatacttagcatttatgatgataaaacttaaaatctacttttaacaaatttcaattatatataataacaacagtaaattgtcattaacagtggtcatcatgttgtaccttataaatctcttgaacttttattcctcctaactgaaatgttgtattttttgaccaaagtttcccccaactgtactccacccacctgtccccagtccctggtaaccaccattctactatctgcttctatgagtttttgacttttttagattctacatgtaagtgatatttgtctttctgagcctggcttattttgtttaatataatgtcctccaggctcattcgtattgtcgcaaatgacaaaatttccttctttcttaaggctgaatagtattttgctgtgtatattacaacatttttaatccattcattcattgatggacgtttaggttaactccatatcgtggctactgtgaatagtgctgcaatgaacatgagagtgcagatatctttttgacatagtgatttaatttcctttggatatatacctagtagaaggattgttggatttatatggtagttctatttttaagtttttgaggaacctccctactgtcttccataatttatatctaatgacctttgttaaatcttactaattctgataatttctctgaggaatttgtaagattttctatatagaacagggagtagaaaactttggcctatgggccaaatttggcccacttttatctattttatgttttaaagacagggtgtcaatctcttgcccagcctagagtgcagtggtgcaatcatggctcactgaaaccttgaactcctgggctcaaggggtcctcctgtctcgccctcttgagtacctgggactacaggcacacacggccacacctggctaatgttttaaattttttgttgttgttgttgttgagatggagtcttgcactgttgcccaggctggaatgcagtggtgcgatctcggctcactgcaacctccgcctcccaggttcaagcgattctccttcctcagcctcctgagtagctgggattacaggcacctgccacacctggctaatttttttgtatttttagtagacacggggtttcactatattggtcaggctggtctcgaactcctgacctcatgatctgcccacctcaacctcccaaagtgctgggattacaggtatgagccaccgtgcctggccatgttttaaaatttttttagagatgaggtctcactatgttgcccaggtttgtctcaaactcctgggctcacacagtcctcccaccttggcctcccaaagtgatgggattataggcatgagccacggtgcctgaccactgcctggttctataaagaaagtttgtataaacacagccacatctattcatttatgtatcatctatgacagctcagagaccatgtagtacacaaagcctaaaatatgtactacctggtcctttacagaaatagtttgccaacgcctgatatatcatctgtgaataatagtgttttcttctttccaatccatatataattgttttcttccttcttttattgcaccaactagtaccctcccccgcttcacccaccccatgacactgatgaacagtagtggtaacagtgagcaagctctccttccagattttaaggagaaatcttcttaaggttcaccattttaaaatgtgctataattttttagtatatacttttgataaatttccttctatctctagttaattaatgattcaggagtttcattgaggtataacttacatgccataaaactcactcattttaggtgtaaattaagtttttttttttttttttttgagacagagtctcgctgtgtcgcccaggctggagagcagtggcgtgatcttgactcactggaacctccacctcctggactcaagcaattctcctgcctcagcctcctgagtagctgggattacaggtgcccaccaccacgccctgctaatttttgcatttttagtagagacgggatttcaccatgttggccaggctggtctcaaactcctgacctcaggtgatccaccctccctcggcctcccaaagtgctgggattacaggtgtgagccaccatgccaggccgcaattaagtaattttttagtaaatttacagagctgtgcaatcatcaacacaatccagttttagaacattttcatcaccttaagagattcctcctgcccattagcaatcactttctgttcccactctcagctccaggcaaccactaatcaactttctgtctctatagatttacctattctagatatttcatataaatagaatcgtacagtaagtagtcttttgcaagttggcttttttcacccagcataattttttgaggttcatccatgtcatagcatgtatcaattatttgttcgttttcattgctaaatagaattctgttgcatacatccaccacattttgtttatctatttaccacttgctggatatttggattggttccatttttgcttattatgagtgctactataaatattcatgtacaagtctttgtgtggccatatatgttcatttctcttgaatagatatctaggagtggaattggtggatcatatggtaactccatgtttaacattttatgaaactgccaaattgttttctaaagtggctattccattttacattcccaccagcaatgtgggtttcagcaatcagggttccagtttctccatattcttgccaatacttgttattaattaataatatggagtcttcgaatccatgaacatggactatctccccatttatttacaacttcttatattccctttagcaatgttttatagatttcagtgtacaaatctcatacctcttttgttaattttattcctatgtattttaccctttttgatgctattgtgaattaaattattttcttcattcatttttggattgttcattgcttataagtagaaatacaattgattgtatatcttgtgaatttactaaacttgtttattaggtctagtggatttcttggtaggttccttactattttctgtatacagaaacatatttcctgcatatgaagacagtttacgtcttcctttctattctgaatgccttttcttttttttacctgattgcacctccagtgcaatgttgcacctccagtataatttcaaaaaaaagtggtgagagccttgcttcccatcttagggggaatgcattcagtctttcaatgttaagcaagattcttagcttttgaatacattcccttttatgcctagttttatcacaaagagattttgtcaagtgcttttctgtcttgattatcatatgggttttgacctttattagtataatgtattacattaactgattttgggagttaaaccaaccctgtattcctgggataaattccacttggtgatgacataaaaatgtttatatatattgttagatttgctaatattttgttgaggatttttccatcctttttttttttaggaatatttgtggtttctattcttttttttttttttttttttttttgagatggagtttcactcttgtgccccaggctggggtgcaatggtgtgatcttggctcactgcaacttccaccttctgggttcacatgattctcctgcctcagcctcctgagtagctgagattacaggcatgcaccaccacacccagctaattttgtatttttagtagaggtggggtttcaccatgttggccaggctggtcttgaactcctgacctcaagtgatccacccgccttggcctctcaaaatgctaggattacaggcatgagccaccacacccagccctgtagtttctattcttatggtgtctgtctggttttggtatcaggataatagtagactcaaagcatgagttggaaaatatcctgtctcctctatattctggaagagtttgtgaaggactgttattatttactatgtaaatatttggtagaattaatcagtgaagccatttgattctgggcttttcactgtgggagtatttttaaattaccaattcaggccagtcacagtggctaacacctgtaatcccagcactttgggaggccgaggtgggcagatcactgaggtcaggagtttgagaccagcctgaccaacatggtgaaaccctgtctctactaagaatacaaaaattagccaggggtggtggtggatgcctgtaatcccagctacttaggaggctgaggcaggaggatcacttgaacctgggaagcagaggttgcaatgactccatcttaaaaaaaaaattaccaattcaatatctttacttgctgtaggtctataagtcaatagattttctatttatcttaagtcaatttcagtaatttgtgactccttaggtgtctatctgttcatctgtgttgcctaatttgttgccataaagttgctcatagtactccttattaatccttttaatttctgtaaggttggttatgatatctcctctcttttgtttttaattatgactaaatgttgaatcttattcctcatttgaaacaatcatacagatttacccattttatctgttaatgtgggtaattatattaatacaatttctattgataaaccatcttttcattccttgagtaagcccaacttggtcatgatatttactataatgtagggttcaatttctttgcatttagaatatttgtatttacattcatattacagattggtctttctttttttttaatattatctttgttaagttcgggtatcaaggtcatactaattttatacatgatgtaagaattccctttttcaataatctgatcagtttaataaaattagaatgttctctcttatttgcaatatttggtagaagtcacctgtaaaactgacagacctgctcttttattagtactgtaggtagtttttaactcattttttccatttctttaatggctgtggcagaggtgatattcagaatatttaaataacaagcaccgcatgaacacttgccagtcagaatagatgcagatggctgtgctggaacagggtcctggaatcgccatattgtgtaagggggacttttgctgctgaatcatgggaaggttttgtgggaggtatctctagaagaggggcctgggtagtcagagggtgtcagagggtaactcagggcagtgcctatttacgaattggtatggaagaagttcaatcttttaacagtacttcagctgaaccagtacatattggctaaatattagtcctagtaataggtctatttcaggttttctatttcttccttggccagttttgctaaggtgtatttttttagtaaactggctatttcatcaaagttttcaagtatatagggataaagctcatctatcatcttcttctatattgttgtctcctttttattgctgatattagttatttatgtcttttttctcttgatgaatcttgccagagaattgcctattcaattagcttttttcaaagagcaggcttttaaaaatcctctattatattttcatttttgacatcatcaattttatgcttttacacttatcatttccatacatctactttcatcgggtttatccttttacttttttccagttttttgagtaagatgcttagttcatcaattttcaacctgtcttcagtatgatttcttctttgatccataaattatttaaaagtgagtttataagtctctaaacatgagaatttttaattaataactaaatgatactaagaacagggaaaatggtttgtgtgataatagttctttggtaccagctgaaacctactttgtagttcagtacatgctcaatttttgtactggttctaagtttgcttcagaggatgttttcactagttgttggtagcagaaatctaaatatgtgtaatacatcaagcttattaataatatttaaatcttccacagccttatccatttttgtttgttgttgttgttatttttcttttttgagacagaatctcactctgtcacccaggctggcccactgccacctctgcctcccaggttcaagcgattctcctgcctcagtagctgggattacaggcgtgtgccactaggccctgctaatttttgtgttttatttatttttgttgttgctgttgttattgttttgagacagagtctgactctgtggcccaggctggagtacagtggcacaacctcggctcacggcaacctctacctcctgggttcaagtgattctcctgcctcagcctcccaagtagctgggattacaggtgccagccaccacgcctggctaatttttgtatttttagtagagatggggtttctgcgtgctggccaggctggtctcaaactcctgacctcaggtgatccacccacctcggccttccgaagtgctgggattacaggtgtgagccaccacacgtggcctaatttttgtatttttagtagagatggagtttcaccatgttggccaggctggtctcctgaccgcaagtgatctgcccacctcagcctcccaaagtgctgggattacaggcgtgagccaccatgcccggcccatttttgtctatcttatctagataagtaaatgagagaatgctgttaatattttccactgagatggagatttctcacttctttcttgtaattctgtccacttttactttttatagttttatgctatgtttttaggcgcatacaagcttttatattttagtgaaattaatcttttgttatagtacctttttatcagtaatgctttttgtcttaaactttattttgtttgctattaatgtagccacaactgttttgtctttgacgtataattgtttgttttttctcatccttttactttcaacttttctaggtttgtatgttttaactgtgtcccttacaaagaaaatacagttctgttttatttttaatctaatctaacactgtctatttttaactggacagtttagcccatatacgtttatcacagttattaatatttggattaaagcttaggttatctgcctactagttttatgctttgtgaaataacaaaaaatatttttcctgaaattaaggaaatttattttgtaagctagttttcatcatgaactatacaacttggtctccttcctgtataattttctccaactttttagttgcagtatatgactagttttgtgcttcctaatttacctgttcttttaaataattatcttttttccttcccttctctgcttctatgggattgatcatgttttattagttttttaccctctactaatttggaagttacatttatatttctattcaaattttatttctaaattttagtaaacaaattcatttagtaggtatgcttgtctttgtctaaagataaccaatagtttttgccttccactcaaagagtatgggtagctagaaatctccaagaatagcccctctctttttacatatgacctctaaaaagaatatttcgaaaatgatggccacacacagtggctcatgcctgtaatccttgtattttgggagctaaggcaggaggatcacttgagcccaggagttcaagaccagcctgggcagcatagcgagaccccgtctctacaaaaaataaaaaattaggtgggcatggtggctcatgcctatagtcctagctgctcaggagtctgaggcaggaggatcacttaagcctgggagatccagtctgcagtgagctgtgactgtaccactgcactacagcctgggtgacaatgcgagaccctgtctcaaaaacaacaacaaaaacaaatatacacagaaatgatcatggtgtgtttactatattatcatttcaccatagctagcaaagcaggcatattttaattgtttttcaaacttcaactctttaaatatcaatttctttataaggagacattttgttggaatgttgcacaacagaggcataactggcattttaggtgggacaactagtccactgtgcacactgacctgtgtactgcaggaggtttagaaactctggtccttgctgactacatgctagtagatagttctcttcccccatagtgacaaccaaaattgccccacgctttattcctaaacattccctttgagatcagtaccattccaaatgagaactactcttttaatgcatgaaaacaaagaacaaaaattgcaaaataaatatatgtagaattgagggaagaaaaagtgagaaacagtttagtttcacaggagaaataacaaaaatatttttccttaaattcaggaaactctttttttataagccagttttcatcattaactatactacttggtctccttcctgtataattttccccaaaatttttagttgcaatatatgactaggtacaattaacaaaatatatcatcactttttggttgcttttcctaaagccagtttccttcttgaggctaggacagaacactgaatttgttcaccatctttaaaaaaaatgtttttgttcataatcctaacatggtctcctattcacaaacctgttagtgtcccaaataatgacatttccatcaaatcctgatgttactaagagtcttgtattagtatcatattcgatgttcttcacccagctagtgtgaccatgtaaagtgcatactttggtgttcaattttctcagatcccatagtgctattgtagtgtcatcagagcaggtagcaaacagccggttatcaagaaatctataaaagcagaaaaacaaaaccctggttcatttaatctctttttaaaggaaaattgatttgagaaacagtcactatattacctagtcaagaaagaaagaaaaaaaggactacacactcactatgtaaacccaatgactgatatactataaaaagtatactttgcataatcacagagccaggatactatgatttaatgacagtcatattgcaattggatccatttgctttaaattactgatttttatttgaaattggaaataggggtaagtgtttggaaaacagtgacagaagggaaaaaaagaacttcagaatctctataggaaacaaaaatgatgagagagaatttaataggcgatagaggaagttttgaagacttgattgccgagagggacacattacacataatcaaaatcatgagaaatatttgctctgctacaaggaacatctttttctatttagaacacagttacatacaaaaattgctataaaattgccattattttaaatcttttaactgaaaggtatttcccaaataatctcttagcaacattttattaggaccaatcaagaaaattacaaaataggcttaaaatactctataattcagactttttattattttacactaacttctcaatccttagtgagaatatatttaatacaaatacttaaaaaataaactactattcacacttgaatttttgcttaatttaacattaggatgctttctgtaatacatgctgttatcctaatctcttacagaagaaatgaattctggtgcttcttctaagataaatttacatataattgtcagaaatcaacctcaatatccacaaacaccataacgaccttcctaaaattgatcacggttttcaaataccaggcgtttacacaggttgtttctgctaggtgaaacaaccttcctcctgcccctggatctggctaattcttgctttctttttaataccatcatgtgtcacttaatgatggaatacattctgagaaatgtgtccttaggtgattttgttgttgtgtgaacatcatagaatgaacttacacaaacctagatggtacacactgaggttatatggtatatatggtatatagcctatcactcataggctacaaatgtgcacagcatgttaccatactaaatactgtaggcaactgtaacacaatcgtaagtatttgtatattgaaagatagaaaaaatacagtaaaagtactgtataaaagatttaaaatgttacgcctgtatagggcacttaccatgaatggagcttgcaggcgtgggagttgctctgggtgagtcagtgagtgaggggtgagtcagtgtgaaggcctagggcattactgtccattactgtagacattataaagactgtacacttaggctacactaaattaatttaaaaatttttcatcagtaataaattaaccttcgattactataactttttttacttcatgaatttttaattttttaaacttttgactcttttgtaataacagcttaaacacaaacacattgtacaactgtacaaaaatattttctttctttatagccttattttattaacttttttctattaaaatgtttactttttaaacttttttgttaaaaacaaagacacacattagcctagttctacacagggtaaaaatcatcaatatcactgtcttccatctccacatcttgccccactggaaggcctccaggggcaataacaggaacagagctgtcatctcctgataacaatggcttctcctggaatacctcctgaagaacctccctgaggctgttttacagtttaatttttttttaagtaggagtacattctaaaataacaataataagtataacatagtaagtattaggcaataggaatttttcagctccattataatcttctggaaccactgttgtatatggtgtcactcactgaaatgttgttatgtggcatataactgtattcagctgttatgccctccaggaagccttccttgtttaaccagcctggtagacctaccaattctctgagctcccaaagcattctgggagcttctatcataatacttaatattatactgtaaggaacaactttactgtaaactccctgaagacagaaggaacctgtctgcctagggtcatggttagatctgcagtatacaatacacatggtgccagacacatatgcactcaacaaatacttacaaaataaatgaaagagaagttcactgcctagcagaaaagacactgtaagtacataattacacgaaataattgtgtggaataagcaaagagggtggctgggaaagacttcatgatgttatcatttgaactgaataaaagatgagcaggaactccctaagtggtcagggttactaagcaaagatacacaggcatgtgagcggatggtgccctctgagaagcagcagttaggagtgctgtgtgtgggaaagtagagatgactagggaatacattatggatttattctatggtgattaccagtaactattttttaattataaaaatacatttcctggccaagcgtggtagctcatacctataatcccaacattttggaaggccaagatggatggatcacttgagctcaggagtttgagaccagcctgggcaacatgacgaaaccccatctcttattttaaaaataacgataacaaaaaacatttctactgaaaatatttttaatgaaaaaaaatcggctgggcgcagtggctcacgcctgtaatcccagcactttgagaggctgaggcgggtggatcacaaggtcaggagttcaagaccagcctggccgagatggtgaaaccctgtctctactaaaaatacaaaaaaaattagctgggcatggtggcgggcgcctgtaatcccagctactcggaggctgaggcagaggcagagaattgcttgaacccgggaggcggatgttgcagtgagctgagatcgtgccactgcactccagctggggcacagagcaagattccgtctcaaaaaaaagaaaaagaaaaaaaaaatccatcaccaaaaataaccactttattgatgtttagcttaatttctgttttaaacctaatattatctcaaaaacatattgccattattaaaggtttattaacaaaatcatgtttaatggctgaatagtgttcactgtatgaagaactgaaaccttttttctttttaatttttttttttttggagacagagtcacgctttatcccccaggtgctcactgcaacctctacctcctacattcaagtgattctcatgcctcagcctccagagtagctgggattacaggtgcccgctgcgatgcccagctaatttttgtatttttagtagagacaggttttgtcaggttggccaggctggtcacaaactcctgaccctcaggtgatctgcctgcctcggcctcccaaagtgctgggattacaggagtgagccactgtgcccggcttctttttaaaatgaatatgcaatttttgggtgtttggattgcttacaattttttactactaaaaaacactaagatgagcatacttacagccaaatattaatcacatccctatgtatttctctaagtatatttccagaaaaacatattgctaagtaaaatgagatttttttaatgtaagttttttttaatgtagccaaattgttctccaaaaaatcataccaatatggagttgcatcagcagttaggagagtgtccattttcccaaatccttgccacataggtctttaaaaaaactttctcctaagtgctaggaaaaaaatcatcttgttttaagttgaaacttttatgtttagtaaagttgaaactttttcacatttattagaaaaatatatttctttgctgttcatgttccttgctgattttacaactgcagtattattttaattactgagttgtaaaaaaaatctttaaagataatatatccgtttttcaaacactgtgcattgcatatattttccacatatttctatcttttatatggtttatgttttcttcccatatcaaaattttaatttttttttttcttgagacagggtcttgctctgttgcctgggctggagtgcagtgatgattatggctcactgcagccttgacctcccaggctcaagcaaccctccttgtctcagcctcctgagtagctgggactatgggcacatgccaccatgcccagctaatcaaaattttaattcttttttttttttttgacacacaagcagtatgtattcaacacactgatacctgatagcatgtcaggaaaagagaacaggcaatgcagtttaaggggggaaaaactgagaagtcataactactccaaagatgtgaaggaaaccacaaaagacatggacctgcttctactataaaaagaaaatgaagcacttctctggggttgctataccaactgtttcagcccattgtagtcttgcctctttcagggctttagccactatttcatttcatggaaaagcagacatctcctaacaaacagagtgacatttaccaaaagaaagagggcttatcaatgagaagcttagtaaagaaaaatatttacctatgctttgcacaattttcttttcttttttttttttttttttgagatggagtctcgctctgttgccaggctggagtgcagtggcgcgatctcatcttactgcaccctccatctcccaggttcaagggattctcctgcctcggcctcctgagtagctgggattacaggcacgtgccaccacgttcagctaatttttgtatttttagtagagacggggtttcaccgtgttagccaggatggtctccatctcctgacctcgtgatccgcctgcctcggcctcccaaagtgctgggattacaggtgtgagccaccgtgcccggcctgctttgcgcaattttcaaaagccattatttctatgcaattttgggtacttactacagtgctggatgcaaagtttatgcagtaaaagcttattgaatgaatgaatcacaggataaataatacaactagtaatttcttaagatcataaattccattacagtaaccctggtaggcaactctataaagttctgggctccaagaagaggtcagtgcatgccataaatgtgtttgatctactgtgaagtatattcacagtcttcaaaatgtaacgcttaaatgagataaaattggttggttaccacccccaaattagcatatgccagcctgcacaaaggtaaatagcaaaaactttaactgctcaatctgaattaaccaaagattccttctaggaatcttaaaaaaaaaaagtaagggtgtgaacacttcaagcacttattttcagatgcatcaactgacataaattaaaaatggtacaaactaataattgaacaccagtagcataacaaaatagaattttcactctttccgctttgagtcaaagtggtttgctcatgtttgttgaaatcagaactgaaacaatgacatgtacaaaaaagagtagataaaagtggttcttgcattaaagttccattccctgctctcagctgatgagggcacgagaactcaatagagcagttagggcagactcaaatcatctcagctggaagcactctccacttaaacatactcatctggcccaccctcatttcaaattcaggcaaaaatggcctccctgaggctttaagacttgctttcttctttttcttctgatagtgtttcccagattggctccttgatgtgttctggtaactgttctaattgtgtctttgttacttccatggcaaccctttcaggtaagtttcgctgaatatattccacgtagacatctgctgtgcttccagttagatgttctaactctaaacatctgtaaagtgttctcatttcatactgaactccgtgcttcttataaatatgcactgatatgagaagagtaaatcgctctattttccttggaggttcgtgtactttaatagagataccaagttctttagcatcaagcacagcaaaatattcataactgtccaatacagccttaccgtggcggcgcggacggcgtttggggccgtgtgccggcgcctctggcagggattggggaatttttctgtaaacagttctaagggcaatatagccaaaaatggtggctttcttctcagtaccaatatgaagtgggtacagttttcaaacctacacgttgatgttccaaaggatttcaccaaacctgtgataacaatctctgatgaaccagacacattatataaaattttaattcttatattgtcaagtccatctttcccttatagatttacctttactgataatgttttttgttgttgttgttttgagactgagtttcactcttgttgcccaggctggagtgcaatggcgtgactctcagctctctgcaacctccgcctcccgggttcaagcgattctcctgcttgagcctcctaagtagctgggattacaggtgcccgccaccacgcccaggtaactttttttttttggacggagtctcactctgtctcccaggctggagtgcagtggcgcgatctcggctcactgcaactccaccttccgggctcaagtcattctcctgcctcagcctcctgagtagctgggattacaggcgcccaccatcacacccggttaatttttgtattttcagtagagacagggtttcaccattttggccaggctggtctcaaactcctggcatcaaatgatctgcctgccttggcctcccaaagtgctgggattacaagcgtgagccaccacacccggccccagctaattttttttacatttttagtagagacagggtttcaacatgttggccaagtgggttttgaactcctgacctcaactgatctgcccacttcgacctcccaaagtgctaggattacaggtatgagccactgcgcccggccctgatgatgctttctaaagtaaaactagttcaatgacttccatatttgacagaaattatgtgactgagactgagcacagtggctcacacccataatcccagcactatgggaggccgaggccagctgatctcttgaattcaggagtttgagaccagcctgggcaacatgatgagacctcgtctctatgaaaaataccaaaattagccaggtgtggcacgagcctgtagtcccagctactcaggaggctgaggcaagagaatctcttgagccagggaggcggaggttgcagtgagtcgagatagcaccactgcactccagcctgggcgacatgagtgaaaccctgtctcaaaaaaaaaaagtacgtgattgagaaaaatacgtacaaaaaatattttctaaaaagctactggaaagttaaagttttaaaataaattgagcatattcatacatttgaaaagtttttaaaaaataacaaagatattttattcggtctacagaaaatacttaatgcacagatggatttaaaaccccagtggggttatattgctgtaggccacagtggtctgagagttttaaggaagagagattattagaatgagagtttcagaaagatctctgaactggctaggtttccagactgttggactttcataaaaaatagggggattagctttttaatttttcttaataaggtcatttaaaaaactataattgttgcatgaaaggatattttaataccaaaaatatagaaaaatataaagttggaataaaagctaatagttttgaattgaataagtttaatgagaaattcaatactttgactttaattggctcatttttgcctcaaaatattacttattaaaaactttgatattggaagttgctgtttagtaaaacataaatttaaaaaaagatggctgggcacagtgtctcactcccgtaattccagtactttgggaggtcaacaagggcggatcaccagagctcaagtttgagaccagcctgggcaacatgatgtaaccccatctctactaaaaatatgaaaattagccaggtgtggtgacgcctgcctgtaatatcagctactcgggaggctgacgcaggagaatcgcttgagctggcggggcggaggctgcagtgagccgagatcgcaccactgcactccagcctaggcggcaaagcaaacaaaaaaaactttggtattggaaaatcactgataaagagaaaaaaattgtagaatattaagaatgtacactaggagataaattaaagcacctagaacaatttttatcccaaaatcaacagatgcagagaatgtagcgttagacaaatccttcgatatgtgggcctagtcctctcaaaactcagtctagcttaataagttaataattgtaaaatatttataactccacagaccccaataaataagagacaacccttcaaacacactgaaatctgtgtctctgaatcacagaacttctccaaatgtccccatcaaaccccagcatacatgactgtaacagctatgggtaagctgacatctggacaaattcaaggtcttcattgtcagatgatatggtaaaggataaaagaaactgaaaatgaattctattaaaatgggtactaacatttcattgtataaatgaaagtgttgttgagtctatatcttaaaaaaaaattaaatgaaaactcatgaaaataacattttcctatttaactacagacgatcccccacttaaaattgtttgactaacaattttttgactttatgatgtttatctgggtattaaatttattttgacttccaatattttcaactgacaatgggtttattgggagataatcccatcagaagttgaagagcatctgcatatgcaaattctcagaacaagaataattaaatgtttggcattttttacttaatcttcccaatgaaataatgatagcagaatatgacatccttacttcatatttgaatttgtagtataatcaaaaagaaggtcatttcagctcacgcctgtagtcccaacactttgagcgaggtggattgcttgaggtcaggagttcaagaccagccccggcaacatagagaaaccctatctctacaaaagattagccaagcctgtagtcccagctattgagaggctgaggcaggagaactgcttgagcccaggaggcagaagttgcagtgagcaatgatcgtgccactgcacaccagcctagtctaggtaacagagcaagaccctgtcaaaaaacaaaaacaaaaacaaaaaataaaaaacaaaacaaaacctaaaacagagagtcatttctgtataaatattcaagggcctcatcaattttcccaagagcctttttccttagtcctgtgagttattcacataatgctttgaggtgtctatcatgtcataattgatgtcattttctttaattgatcactactcttaattctatgatatcattatctgccagtgattttatattacttgaccagttctctaacataattttcagggttttgcaaaattctgcatcctttgtaagataagaaatttcgtgttcccactgacacagcactacatttgcattatatagtttgaaatttaacaatcagcagcacgccaacaaagacagtgggagggagaaatagatcctgggatatatttaaatgggtatcaatttttttttttttttgagacggagtctcgctcttgttgcccaggctggcatgcaatggcgtgatctcggctcactgcaacctccacctcctgggttcaagcgattctcctgcctcagcctcccaaatagctgggattacaggcacccgccaccatgccccactaatttttgtatttttagtagagatggggtttcaccttgttggccaggatggtcttgaactcctgacctcaggtggtccgcccacctcggcgtcccaaggtactgggattacagacatgagctaccatgcacagcctaaatgggtactaattattattatttttttttagatggttcaagcgattctcctgcctcagcctcctgagtagctgggattacaggcacccgccaccatgcccgactaaataggtactaattttttaaatgtaatatcactaagtaaatatttttatgatgacctccgggcttctccctgcaacttcataactggggggacctagatcttttttttgttttgttttttgagacggagtctcgctctgtcgcccaggctggagtgcagtggcacaatctcgggtcactacagcctccgcctcccaggttcaagcaattctctgcctcagcctcccgagtagctgggattacagatgccggccaccacgcccagctaatgattattaaaggaactctaaatccacatacagatccctcaggaatgagaagtaagcctgtataatgggtgtaagtatttaaattacagacttttcccactactttcccaaaatatgaagtaatagaaaatattgtccgtaactaccaatgttttttatttttttattttacaagataataagcaaactacaaaactaagaaatgaactagaagacattaccaagtatgtacaaaatgaccgtctagattcaaaccagaaaatgcatgcccctgtctctgaacagtacagtgaggtgatctaatggaactgagtatgaattccagctccaccacttactatatctaagaacttgggcaaatctctttatttgagttatagttttttattccttaaatagctacaatatctgtctcacagagggatactgtgaggattaagtaatgtataaaaagtgcttcacagaaggtttggcacatagaaagcattaaaaaatggaagttagtattattaataaataaagcacacttgagctcatgcaccaaagactcttcagatcttcactcaaaactttctttttttttgagacagagtctcgctctatcgcccaggctggagtgcagtggcgcgatctcggctcactgcaacctctgcctcctgggttcaagcgagtctcctgcctcccgagtagctgggactgcaggcgtgtgccaccacgcccagctaatttttgtatttttaatagagacggggtttcaccatgttagccaggttggtctggaactcctgacctcaggcaatctgcccacctcagcctcccaaagtgctgggattacaggcatgagccactgcgcccagccaaaactcttaagttatgtatacttctaaacgagcttcaaaatcgatttctctaatcaacagatcagaagaagcagattcaaatttgtaggcatgagttgctatggcaggcatactggcagcagcaaatgaaggctaacattgataaataatacattctaatagcggattagccaaaggttgttttgagtaaaggcaaacaacttggcacaagtcttatctttctaagaaatttttaaattataacatattagcaacatagagaaaactatgaaaaatataacaaacatctgtgataccactcagctttatcaattttaacattttatctttcacatatttttgaacattacaaacacagttgaagtgccttgtatatccctccccagtcccttcccttctcttcctccccagagggaaccactatccaaaagttgttgttattcccatgtaaatttttaataccatgaattcatatgtatgtaaccataaacactttatagtattgttttgcgttcagttttttctctgtaaatgtttaataagaacccaccatatgctaggcacaattctagatgctgggatagagcacagaacaaatacatgccctcaccaagcttatgtttgtaatgttttcaaattttatgtaaatggtatcacactatataaagctcattctacatttttttcttttctacctcaactttaaatttctgagatgtgtatcagatgctgatgcttttagttcatttatcttaactgatgtatagtatttcattgtatgagtacaccagaatttatttatctattaatatttcctcttgatagacattcgtttccaacttctctctattacaaacaatgctataatgaatcttcttcatatacctccgtgtccacatatgcattaatttctttcttcttcttctttattctttaagagacagggtcttgctctgtcacccagactggaatgcagtggtgcaatcatggctccctgcagcctcaaactcctgggctcaagcattcctcctaagctttctaagtagctgggactataggcacgtgcaactacacctggctaatttttaaattgtttgtagagacggagtctcactgtgttgcccaggctagtcttgaactcctgccctccagtgattgtcccacctcagcctcccaaaatgctgggattacaggtatgagccaccatgcccagcctgcatcaattattaaaaaaaaattaatcttcagctttaccatatattgctcaactgctcttcaaaataatgttataaatttatacttcatcagtaatatctaagagtgcctatttctcaacgtttcgctgccgagagaaatagcaagtatttttctgccaatacttggtatttactgttatttttatttgtacttccataataaatgataagcttgaacatctttctgtagttattcttcattgtagttttttgttttattttattttatttattaatttttttgacatggagtcttgctcttgttgcccaggctggaatgcaatggcacaatcttggctcaccgcaacctccgcctcccgggttcaagtgattctcctgtctcagcctcccgagtagctgggattacaggcatgcacgaccatgcccggctaatttttgtatttttagtagagacggggtttctccatgttggtcaggctggtctcgaactccctacctcaggtgatccacccaaaagtgcgggaattacaggcatgagccaccgtgcccggcctgttcattgtagtttatcttaggtgattctctgcctcttttgctaaagggctattatcttatatactaatacttttctggttatgtacattgaaaataccttctcccaccaactatagcctatcttctcacattattatgatgcgtttggttacaatgaagtttaaaatttttatgcagttgaactgatcaatccttaatgatttatgctttttgtatctaaaaaaatcctttcttacacttagaatacaactatattctatactttctcctaaaactttaaagctttgctttcataattagatctttaatctaactggaagttattttcacttatggtgtgaagtagagatctaattttattctattttttcatatatatagccaaacctctcttttccatttccaccccgcactggttcataatgcccctgctatcatatacaacatttttatagatacacaggtctgtttttgggatattccattgtcacttaatctactcctgttttaagactacatactataggcatgcaccaccatgcctcgctcttgctgttctatataagttttaaaatcaagttttatgaaaaagtctgttggtatgttaactaaaactacactggatttatggaataatttggggagaatcaacttctttatgatgctgactttttgcctccagagaagatttgaatttgttttccttttcttttttcttttttctgagagggggtcttgctattttgctcaggctgtccatgaactcctgggctcagccttggcctcccaagtacctggaactacaggtgtgtgccactgcacctggcagacttatatttgtttttacagatacatgacagtgcttccaacctgaatccaattgaaaattgttggctggagattttgaactatatggtagtgtgaatttgggtcccacacatgcacgagtgctggattgtggttagatattcacagaggagggccaggcacagtggctcatgcctgtaatttcagcacttagggaggccgaggtgggaggatcgcttgaggtcagcagcgtcagaccagcctgggcaacatagcaagaccctgtctctacaaaaagaaattttttttaatagccaggggtggtgccacacacctatagtcccagctactcgggaggctgaaatgggaaaatcccttgagctatgatcatgccactgaactccagcctgggcaacagagtgggactctgtctctaaaatagagggagactttctctaaaataaaataaaataagatattcagctacttctgtccccaatgccacagcctagatgaacagggtggtttatctctagatcacctttttgctgaaagtaagcacttttggggtcccagccttatgcagagtcactttctactaaattcctcaccttaaactggttctagaattatctctcttgttccctttacttctcatacttgtcaaaacagaagctcaaggtcaccagcacttggcagaagcctccagggtaaaagccaactgaacacctgtttacttctttgcattcctgattccatttcatttttggcccatggattcctgtctttcttatcagctcaactacatattagaaatatatatatatattacattttatccagcatttgtttttaattagaaacattgttcaggatattttttgttcttaaaaacatatttgtttaatgtaaatacattaactctaccaccattttgataactctgttttgcaccttttctttttgtttttgttttctacctgcttgtttgcttgcttgtttttgagacccccagatgcagaaggtggagttaatcatacttttatcctattgtagcatattttcatcaccaatctgtgcaaggttcccaggtcactttgttgtctaagcatttgtttccatttatccccacctccaactttcatttcctcccctacccatttacgcaaggattttgttctgatcgcatgtagttgcttcttatgttggtgttcttacaaaataggtattgtggtggccgggcgcagtggctcacctctgtaatcccagcactttgggagaccaaggcaggtggatcacctgaggtcgggagttcgagactaccctgattaacatggagaaaccctgtctctactaaaaaatacaaaattagccaggcgtggtggcacatgcctgtaatcccagctacttgggaggctgaggcaggagaatcgcttgaacctggaaggcagaggttgtggtgagccgagatcgcgccattgctctccagcctgggcaacaagagcacaactccatctcaaaaaaaaaaaaaaaaaaaaaaggtattgtggtatttgggtgtatgttttatttgcataaatgatagtgtattacatattctgcttcttactattttttctctctaaaaaactgctaggttctgaaatctcatacatgtggcacaggcattatctaatctgggttcccattgccgaacatcaccctggtgtcatctgccacatttcacctgtgcattctctcattgatggtgggcactcagttggctccagtgctctcccacgtacatacaccacaccaaacaacctcaaacctgtgggctcttgtggatcctatgagaatgtctctggactatatactaagcagcataactgctgggtcatagcattagtagccctagatccttccagaaaggctatagcatccacaccccatcagccatcaagatacagaacccatctatgccaacatttggcttatccagcttttaaatttttgcagtccagtagatgtaaagtgccattttgttctaattctcatttgtgtgattactaataactttaagcttctctttacatgcataatagctgtaggggtttcctttctatcaattgtttgtccatatcctttgctcatttttctactggggttgccctcctgatttttatttgcaggagtcccttgtatattctgggcattaatcccttgtcagcttttaacattgaaataccttttctcatttgttcagctatgcattaactctgttcatattgccttttttttttttaaagaaatataccacttttttaaacttttttttttttcttttaagatggagtctcgctctgtcgctcaggctggtgtgcagtgacgcgatctcggctcactacagccgccacctcctgggttccagcgattctcctgcctcagcctcctgggtagctgggattacaggcacgcgccaccaagcctggctattttttgtttttttgtttttttgtatttttagtagagatggggtttcactatgttggccaggctggtctcaaactcctgacttcaggtgatccgcctgcctccgcctcccaaagtgctgggattacaggcataagccactgtgcccagccacttttttaaatttttaagttcaggggtacatgtgtaggtttgttatatagctaaacttgtgtcatagaggtttgccgtacagattattttgtcactcaggtattaagcctagtactcattagttatttaacctgatcctctcccacctcccaccctccactctctggaaggccccagcgtctgttgctcccctctatgtgtccatgtgttctcatcatctagctcccacttctaagtgagaacatgcagtatttggttttctgttcctgcattaatttgctaaagataatggcctccagttttacccatgttcctgcaaaggacatgatctcattcttttttatggctgcatagtattccatggtgtatatgtactatgttttccttatccagtctgccattaatgggcatttaggttgattccatgtttttgctattgtgaatagtgctgcaatgaacatatgcatgcatgtgtctttattcctttgggtatataccctgtaatgggactgctgggtcgaatggtagttgtttttaggtctttgaggaatcaacacactattttccacaatggctgaactaatttacactctcaccaacagtgtataggtgttcctttttctccgtaacctcaccagcatctgtatttttttgactttttaataacagccatttgttcaggatattttaaaatcttctactgcctaatttttatctgcttgatttatcagttttggacacacctgtattaaaatatctcactataattgtagacttctaattctttataattctgtttttgctttgtgtattttaaggctatatttaaggtgcattcaagttcataattattatatcttcttggtagacttttccttttattaatgtgtactgtttcattttatctttattaaagcccttggtctttcatctgtctgatattgataatttctatcagttttcttttcccatttctcagtggttttatttttggcattgctaaacatatatcaatagagcaacagataaataatttggctttttattcaaattgttgactcttaacaaagaaaattaatctatatttactttgaactactcatatatttggaactctttctacttctcattttctatattctatttatcatcccttttcttcatttaaattttttttttttacttttttaaactatccttttactgaactgattaagttttcaatattctcttttgcccttctgctgctttgagagctataatggtttgtatttccattattttagttaaatcttttcagtttttttcattacatatatttaattatacattttgctagaagagtctgaattacttaatatttttatcttcctcttgaacatgaagagggccttaacatattataccttcccacttaacaaaactcccccgtgcatacaatctatttgttgttactatctagaaccacactgtccaatttggtaatgtagccattacctacatctgcttttgagtcattgataggcaggcagtctgaattaagatgtgctctaatgactgggcacggtgcctgatgcctgtaatcccagcacattgggaggctgaagcaggtagatcatttgaggtcaggagttcgagaccagcctggccaacgtggtgaaaccccatctctactaaaaatacaaaaattagctgagtgtggtggcacatgcctgtaatcccagctactcgggaggctgaggcacaagaattgcttcagtccaggagatagaggttgcagtgagctgagatcacgccactgcactccagcctgggcaacatagtgagactctgtctcaaaaaaaaaaaaaaaaaaaaaagatgtgctctaagtataaaatacaaactggattttgaagaaagcatgaaaaaaatgaaagtaaaatatctcaataatttttatattgattacatgttgaaatgataatattttggacatactgggttaaataaattattaaaaattaattttacctcttttcttttttagtgtgactactataaaattaaaaattacatatgtgattagcattacatttttattggatagtgctaatttagagttttagtttttattttgttttacatgtaccccccgccaaaaaaactcctaaattcttttctcttaataacagttaacattttacctaattacaattctttagtctggattaacagtttccctggacataacatggtattgaacattattttaccttcatattgaagatattaatattactccattttctcctgatatcaactattgctaatgagaaacctgtttctgtaattattgtacttctgtaggtaatctggcttctaactttggtggcttctaagattttctcttgacttttggtattctagagtttcaccacaacctgtctagatgcagatttatctttatttaaactgcaaacactataaagttcacttttgatttgatgtctcaggcccttcagcgctaaaaattctcagccattgttatcttcaaaaatttagttttctaccaatatttttctataactatacactgtaatctctcaattaatcctgtctttcaactactttttcatattttaaccttttttatgtgttctgtgtgaattttaagtgctatattctaactcattaattcatttatcaatagtgtaaaaggtaaagtttatcccatctattgagttttttatataccaactacataatttctttttctttctttttataaggatagagtcttgctctgtcacctaggctgagagcagtggtgcaatcatagctcactgctgccttgaactcctgggctcaagtgatcctcctgcctcagcctctcaagttgctgggattacaggtgcaagacaccaagcccagcttgacttttttttagttttattttatttttccataagttattggaatacaggtggtattcggttacatgagtaagttctttagtgggaatttgtgagaccctggtgcacccatcacccaagcagtatacactgcaccatatttgttgtcttttgtcctttgcccaacctcccactcttccccttaagtccccaaagtctattgtatcattcttatgcctttatgtcctcatagcttaggtcccacatatcagtgggaacctatgatgtttggttttccattcctgagttacttcacttaaaataatagtctccaatctcatccaggtcattgcaaatgctgttaattcattcctttttatggctgagtaatattccatcatatatatatatatatatatatatatatatatatatatcacagtttctttatccattcattgattaatgggcatttgggttggttccacgatttggctattgtgaattgtgctgctataaacatgcgtgtgcaagtatctttttcaaataatgacttcttttcctctgggtagatacccagtagtggaattgctggatcaaatggtagttctacttttagttctttaaggaatctccacactgttttccatagcggctgtactagtttacattcccaccagcagtgtagaagtgttcctgatcaccacatccacaccagcatctactgttttttgattttttgattatggccattcttacaggagtaaggcggtatcgcattatggttttgatttgcatttccctgatcattagtgatgttcagcattttttcatatgtttgttggtcatatgaagaattattcttctgagaattatctattcatttccttagcccaattttttaatgggattgattgttgttttttttttactgatttgagtttgttgtagattctggatattagtcctttgtcagatgtatagattgcgaagattttctcccactctgtgggttgtctgtttattctgccaactgttcctttcgccatgccaaatctctttagtttaattaggtcccagctatttatctttatctttattgcaattgcttttggggttttggtcatgaaatccttgcctaagccaatgtctagaagggttttttttattatagtttcaggtcttaggtttaagtccttaatccatcttgagctgatttttgtataaagtgagagatgagaatccagttacattctcctacatgtggctagccaattatcctagcaccatttgttgaaaagggtgtcctttccccactttatgtttttgtttgctttgtccaagatcagttggctgtaagtatttggatttatttctgggcagcttgacatttttaatttctaagagttctagctagttctctactacattgacttcttcttgttcaatctcttttgtttcagtttttaagctctctttaattggaacgtatcccttaatttatttctctgagcatccttaaaagttaaagttaaaagcaaaagttaaaggcttaaaagtttctcccaatcattggaataccatgcagctattaaaaagaataaggtaatcccatgggtattaatatcaaatgatctctaaacatgttattaagtgaaaaaggcaaggtaaataataatatgtgtaaatgctaccatttatataaaaatgtacatatgtgtgagtgtgtgtgtgtgtatatatatatatatgtttgtatatgcaacaattatcttagaaaggatagcaagaaatgggtaacagtggttgcctttggggagggaaactgggtggctaggtgaaagaggtggagatagacttacttttcactgtttaccctttttgtacctttgaattttgtactacatgcatctattactagtcaaaaataaatacataatttattttttaaaataaagtctttgttgaactgctccataaaattaatttcatccagagaaatgaatgttttggtggctgattttgttatattaatattatatgtctttataaattttagaatttgggttataggtttcttttgaatagaaaaggtttttaatttctctctctcctcctatttaatggtttcagagttgctcccacttggccatctgggcccccagtccacaactaggccttataatgacatttcggggctccattttaatcatgatactggaaatatcatacatagacattcagttactgactcagcaagtggcttcattcaatagctattgatgaggctgtgtttttatcagctaaaacttatagtctcgggtagtgaatagctcttttctcttttcagcctttcataaataagacagatattttaaccaaaccccggacttcatgtagtgattctggctctggttcctgcctcgcatgaaacacttaagcacttcttaatccttttacctgacaggagcaaaactactagctgtcagtgctagactgaaagccagctggtctgtggtttcagccccgtttaaaactttgtgtccatgtttcatttctggcccacaaagatgtttatgttgtttcagaacctggctatactttttgtactatttaatttattgttctatgtgttttgagcataggagttacatcaaaacacccagtatgttacgttgactagtaatttacctatttctttttttagaaaattaaaagtaataattataaaagtaatataatctcattacatagaaaaaatagaaaattacttataatccatccattttaactactgttagaattttaaaatatttccttttaatctttttcttctgtatcatctatttgtataattcttatcacaattttaccctgtattatgcgaagcatttgtctatgttgctatgtagtctctatgaccatcattttaatgactgaatattaatcaccaaactactcaattataattcacttcccacattattgaaaattaaggagcttccaatgatgctacagagaaattgtctgtgcatgtactttttcctcttaacagtctgtatttctgcagagagtggtagggtggaagtgagaggtgctaagcaatgggactgccatcattctacacaaatcattagcacaaaggcattacaggactagcataatacatggctgaggttcataatgatgaccctaatatatgaaaaggtaaaattatatagaagttagaaatgtatttcagaaacattccaatccaacatagctaagagtaagttttgtaattaaaggattagttttataagggattagattcacaattcacaatgtggatcatctagcagtgctggataaggcattaaacattttcattttcactaacttccaaaacagaacattttgggccacactgataaagttcactttttcactataatactaacctgatattatttacacagtcttcatgagcttcagaaagtgtttttatgtgctttgaagatatagggtcaaaaagcagaacttcagtttgttcacaagcaactgtcagcactgacctgaaagcaaatgacacatttatcttgtttagttttctagcattcgctggttattgatgttcacttatttataattacacaagctataggtaaataactttttttttttgcccatgttagtagcaaatgtttaaaagattgatactatctgtggttggcaagagtagtaggaaatggtactctcatacattatcgtggagtataatctggtacagcttatgtttgcacagcacctctaaagtatcagaatttaaaatgggcatatgttttgactcagcaattttttctgggaatttaatctagagaactaattacttacaaatacaaagagacatataaagatatgcttcattgtaaaaaggagaaattcaaagtatcttaaatgtacatgacacagggagtgattgattatacaagccatagtacacaatactttgaaatactgtagagaagttaaaaaggggtagctttatatgaatatgaaagaactccaaaacatatttttaaataaaaaaggtggttgccaaaaaaatgtacattgatgagacaacttacgggaaattcatatacaaccaaattatatatttcttcatcactgtcaataaaatgtactggaaaatatctggcatataacctatcagagcagttaaacatagtcaaacttatcagtcttttccttcatggttttttaggtttgtctcttgtttcaggccttccccactgcaaagttatatttttataaaccttttacaaaccttgttttgatttgtgaaaatctattgtattttattttatttattttgattaagtataagttttttgtgggccctgctctttcagattcatttcatttctagcaaatgaaatcctgtgtattttatacaactaagatgaacgtacataagatagaataaatagccaaaaacttttctattcagaacaaactttttaggtaaagtgggagattaaaaaacaaccattaagttgaaatcttggccgggtgcggtggcccacgcctgtgatcccagtactttgggagaccgaggtgggtggatcacaaggtcaggagttcgagaccagactggccaacataatgaaaccctgtctctactaaaaattcaaaaaatgttagccaggtgtggtggtgggggcctgtagtcccagctacttgggaggctgaggcaggagaatcgcttgaacccaggaggcggaggttgcagtgagccaagatcacgctactgcactccagcatgagtgacagagtaagactctgtctcaaaaaaaaaaaagttgaaatcttttctttatttactaatcatggacttgtctgcataaacccttttttaagacatctggacttcaaagtttaataatatctgaaattttttatgctagtcattgggagtaaaaatattcaaattaatatttgtaatttttgaagacatataaatagctatttctttttgtaagtcagaagaaccctgaaatgaacttttttcccttttgtgcataagtagtgaatcaatgattctgggagacttttttttttggtggagatgggatcacactatgttgctcaagctggtctcaaattcctggcctcaagtgatcctcccacatcagcctcccaaaactctgggattacaggcatgaaccaccagtcccagactctgggagattctttttttctgagacgaagtctcgctctatcacccaggctgaagtgtggtggcgcgacctcagttcactgcaacctccacctccctggttcaagtgattctcctgcctcagcctccagagtaactgggattacaggcacccgccaccacaccccactaatttttgtatttttaatggagacagggtttcaccgtgttgccctggctggtctcaaacctcaagtgatcctcctgcctcagcctcccaaattgctgggattataggtgtgagccaccacacaaagccaacctctgggagattcttaatcttgaacattgtataaaagggatctataaaactgttagttattgctttgtttgaatcaaattatagtatatttttgtacatggtatgatatgtatcttttaaaatatacatatttttttaaaagatacatattgctttgtttattgctggtacacaatttgtcccaatatcaaggctgatcttatttacattggtttataatgccatcttcactacatacaagttttgttcttcgactgtatattggtattctatgcaacatcacactatcttaatttctagaaggcttatgatatatttgctatgtggcaaagcaagactccctcatttgctttactgacactttttcttggctaatactatgctttctcttcaagtaaattttatatataccatgtcaggttctgttaaaaaattttgttgaaattttattgaaatgcactgactttacagattacttaggtagaatttatatgatacaatattgatttacctcatacagtaatatgcacattttcccacacattaaagattttcttagagtatctgagtaaatcttggatctttgaccatccttatacaattagaatcaacatatcaatttatgtatacacacacacacacacacacacacacacacaccccaggtgcagatgttaattgagattatattaaatctattaataccaaaaggttgtgttgtttttttttgagacagagttttgctcttgttgcccaagctggagtgcaatggcacaatctcagctcactgcaacctctgcctcctgggttcaaaagattttcctgcctcagcctcccaagtagctgggattacaggcatgtgccaccatgcccagctaactttttgtatttttagtagaaacggggtttcaccatgttagccaggctggtctctaactccttacctcaggtgatccacccacctcagcctcccaaagtgctgggattacaggcgtgagccatcgcgcgtggcccaaaaagttgtaatggaactgctgtctttacaatatggaatcttccaatccattaacataatctatctccatttatttaaatcttctgtaattctctcaacaaaattgtatagtttcctccatatggcccatgcctaccttctgttgaacttattcctgggcacttgatttttttttatatttgaataaatgttcttttaaaatttttgcttatgctggacacagtggcttattcttgttattccagaattttgggagaccaaggaggaaagattacttgagctcaggagtttgagaccagcctgtgcaacacagtgagaccttgtctctacaaaaaatttaaaaattagccaggtatgatggtgcacacctgtagtcccagctatttgggtggctgaggtgggaggatcagctgagtcagggaggttgaggctgtagtgagctataatcatgccactgcactccagcctagctgaccaagaccctgtctcaaaaaaaatttttttggctttgcttattgctggtatacagaaatgtaactgatttttaaatattgattatttatcaatcgatcttactattctattatttggggtttttggttgataataataccatctaaaaataattgctttgttcttcctattttttttttttattggagacagagttttgcgcttgttgcccaggctggggtgcaatggcgtgatctcagctcactgcaacctccgcctcccgggttcaagtgattctcctgccgcagcctcctgggtagctgggactgcaggcgtgtgccatgatgcccagctaatttttgtattattagtagagacagggtttcaccatgttggccaggctagtctcgaactgctgacctcaggtgatccacctgcctcggcctcccaaagtgctgggattacaggcgtgagccaccatgcccagactgttcttctttttaaaaacctgtttccttctctttttggttgttatactgactaggactttcagaacaatgttgaatagaagtgttaatagcaggcactcatcttgttcctgatcttcaagaatatattcaacatttcatcattaagtacaatgtttggtgtaggttttttgggcagattcctactattagattaaggaaagttctgtttcaattttgctaagctttcttttcatgaatatatgtcaaactgtgtaagagatttttcagcatttattgagatattcctatatttttcctttaatatattaatgtagttatttacattaatttactttctaatttcaaatcagtcttttatttttacctcattgctagattcagttggctaatattttgtttatgatttttctatctttattcttcagcgaaattgcatggtaattttgctttcttgtgctattcatgtcagattttggtataaagtgtatgctaacatcatggaatgaattaagactggctcttgttattttatacactggaatagtttatataaattgggattatttatttcttgtaaatttggtagtgctagtctataaaaccatctagacctaactactgatgcagtattattggttatgatactactttctaatcttttactaatgtcagttttggtaatttctacttttctaggaattagcctatttcattgaactttagaattttattggcatgaagttgttcacaatatcctctgtttctatttttaaactttaaaggccagacacagtggctctcacctataattccagcactttgggtggctgaggcaggaggatcacttgagcccaggaatttgagatcagcctggcaacacagcaagaccctgcctcttaaaaaaaaaattgaaggccaggcgtggtggctcacgcctgtaaccccagcactttaggaggccgaggcgggcggatcacaaggtcaggagtttgagaccaggctggccaacatggtgaaacccatctctactaaaaatacaaaaaaaaaaaaaaaaaaaaagccggcgtggtggcacatgcctgtaattccagctacttgggaggctgaggcaggagaatcgcttgaacccgggaggcagaggttgcagtaacctgagatcgtgccattgcactccagcctgggtgacagaatgagactccatctcaacaacaacaacaacaacaacaacaacaaatatatatatatatatatatatatatatatatatatatatatatatagtgacaaatagtttcaaagtggttcaattgcactctgatctctattccttctttttaccttctttgggtataatttgttgttctgtttcaaagttcttgagatggatgcttacttagcttattgacaattcagcctttcttcttttctaatatctgcatttaaggatctaagattttcctctatacatggcttcagctgcaattgcacaaattttgatagtgttttcatcattcagtttcaaatattttataatttatactgtgatttcttctttgactcacaagttatttaaaagagcatttccaaaaataaagagattttctagttatttatttcctgaactttcattgaaaaacaaactgcttaatctcaatgcttggaaattgtatgaatttgttttttgtgttgtctgatattaacataacacaccaactttcatttagctaatgctagcagtggtatgccttgacatccttttactttaaaactttgtgtatccttacatttcaggtatgtcttctgtaagcagtttttaaaaatctgatctgacaatcattgtctcagtcaaattacatttaatgtaactactagcaatctttgagttgaaatctgtcaccagagaatttactttccatttgtcctgtctgttctatgtcccttttcagttgctttaaacatttttttggccaggcacattggcccatgcctgtaatcctagtgttttaggagtccaaggcaggaggatagcttgtggccaggagttggagatcagcctggacaacatgtggagaccctatctctataaaaaaataaaatggccaggcatagtggcttatggctgcagtcctagctgcccaggagacaggcgggaggattgcttgagcccaggagttggaggttgccgtgagctgtgacagcaccaatgaactccagcctgggcaacagtgcaagatcccatctctaagaatatatatacatttgctattgatatctccccatatgctatttagtatgttaaatatatttttactcttcttttagcgaatacctaaagagctaacatcatgcatcaactttttaaagtgaagtacgtaattattacttcctggatgatgcaagaaccttagctcacttcaacttcctttatcccatcctaatatttaattttttagatataattatatataaatttaatgctctactaaaatttttcatgttttataccattcccagcctggacaacaaactgagacccttgtctctacaaaaaataaaaaaattagccagccatgctggcgtgtgcctgtggtcccagctacacaaaaggcagaggcaagaggattacttgagcccaggaagtcaaggctgcagtgagcagtgttcatgccactgcactccagcttggatgacagagagagactctgtctaaaaaaatgaaaaaaaagttcacattcattttgatttacacgcatatttatttttgttcttttcattctttcctgtacctctgatcttccacctttttccttcctcctaaagaataattttgttacctgtttctgtgtagatctgatagtggcaaattctctcaatatttgtctggaaatatctttgtctcttgacttccattgtttctgcagtgaacttagctctctttttgagcctcctttgaaagtaatctatctctttcctctagctgcttttaagattttctttgtctttgtgcatgtatgttttattttagttttagcagctttactcttgtagctaagtgtggctttatatttctgtctttttttcttcttttttttgttgtttgtttttgaagaagttggtagggatttttgtttttgtttttaaagcagttggaaggttttttttttgtttttgaagcagttttgtttcagaaggtttggagtgtggtggcgctggaatgcagtggcgcaatctcagctcactgcagccttgacctcccagattcaagtgatcctccttcttcagcctcctgagtagctgggaccacaggcgcatgccaccacacccggctaatttttttgtagagtcagggttttgccatgttggccgggctggtctcaaactcctgagctcaagagatccaactacctcagcctccataagtgctgggattacaggggtgcgccaccatgcctggcctgctttttttgtctttctcttgcttgagatgtatagcctttcttgaatctacaatgtcttttgttaatttttaaaattgtcatccattatctgttcaaatattgatttatcttcattctctttaatatctttctgaaactccatttatatttataagatcttttccctgtatcttatgacatatcttaatctctatgtcccattttggtaaatctgaactttattctgtatatttttttctcatctattctcaagctcacaaatccttcagctgtgtccagtttgctgttaaatcatccagtgagtttttatcagttactgtactttttagttctagggttttctttttttagcttctagttctctgctaaatttctccatcttataattccttgaacatattaaatagttttaatgtcagatctcctgtgggtctatttctattgtttgctgattttcttggtttttcagacaacgaatctctttgtactagtgctcgtcactgtatacaaaaattatagggataatttaaagcactggatgatatattatatttttaaaaaaatttctttagagacagggtcttgcttggtcacccaggctgaagtgtagtgatgtgattatagctcactgtaacctcaaacgcctgggcttaaacaatcctcccacctcagcctccagagtagctagtatggcaggcgcacaccaccttgcccagctaatttttagattttttgcagatatgggatctctcactatgttgctcagactggtctccaactcctggcctcaattaatcttccctcctcagcctcccaaagaacttggattaaaggtgtaagccacggcactcagctgcatattttcttcttccatagaagattcatctttaattatggcaagtaagctagagtagaggtgccggcaatctgaggtcttcttaatctacgtagggaatgagattatttgaagctggcctttagtccccatgagtactgtcgattctggattcacctttagtcctagggtatactgggtgaggggaggggagtttcaatcccaaacctaaattgcggatcctaaattgcaattcttgtaatctcatctatcccacccatgagtccattagaaataccattcagaggccaggcgcagtggctcaagcctgtaatcccagcactttgggaggccgaggcagacagatcacctgaggtcaggaggtcgagaccagcctgaccaacatggagaaagcccgtttctactaaaaatacaaaaattagccgggcgtggtggcaggcgcctataatcctagctaatccagagactgaggcaggagaatcgcttgaacccgggaggcagaggttgcaatgagccaagattgcgccattgcgctccagcctgggcaacaacagtgaatgaaactctgtctcaaaaaaaaaaagaaagaaagaaagaaagaaataccattcagcctcattgctgctgctgcttttgagattgacagatgtctctcagagaagcgagctcaaatgctgggctcacatcactggctttcctattttttagaacttgaccctgcaatttcttcatttccctgataatgctctaatcccctcacacataagctttctatatcttacattaaatatttaatattttctctagcttttctgattattctcagttggaagtttggtccaaacaatctacctcttgcatataaaattgtccccccaacttttttttttttttaagatggagtttcgctctcgttgcccaggctggagtgcagtggcgcaatctcagctcactgcaacctccgcctcccaggttcaagtgattctcctgtctcagcctcctgagtggctgggattacaggcgtttgccaccatgcccagctacttttttgtatttttagtagagatggggtttcaccatgttagccaggctggtctcaaactcctgacctcaggtgatccagccgccttggcctcccaaaatgctgggattacaggcgtgagccaccgcgcacggccgccccgctccccctaacccttttatttttttaatttgagacagagtttcgctcttttgcccaggctggagtgaagtggcacagtcttggctcactgcaacctccgcccctcgggttcaagcgattctcctgcctcagcctccggagtagccgggattataggcgcccaccaccatgcctggctaatttttttattttgagtagagtcagggcttcgcctgttagccaggctggtctcgaactcctgacctcaggtgatccacccgcctcggcctcccaaagtgctaggattacaggtgtgagccactgtgccgacctatgtccctctttttattctgaatattatctgtgcattttcttagtaccatggatgtttttcatttttataagtgttttcaaagacaaaactttgtccctattcagtatttctgatggtttttaaaatttcactaatttctaccttttttttttttttactatatttccttctgctctctttagattgattttcctattatttgcagataactttgctattctctttcatgagatgaatacttagctcattaattttccttatcagtttattaaagactataattttcctactaagtacagctttacttgtatcccacaagttttgagacatatgatttcattatcatttagttctgaacatttctaatttccattataatttcccctttgacccatgaatttatcaattctttttgaaaatgaatgagacttttctagttatctttttttttttttttctttgagacagagtctcattctgtcacccaggctagaatgcagtggcaacctcaaactctgaagctcaagcagtcctcctgcctcaccttcctgggtagctaggaccacaggcacatgccaccacaccaggctaatttttaaatttttgtagacagtctttcttccttgcccaggctggtcttgaactcctgccagatcctcccacctcagttttccaaagtgctgggattacaagtgtgacccactgtgccaggtctctggttatctttttaattatacttgtctcttgacttccaaaaatataaaatatataatatatattatataaatatatattttatgtatgtatttttatatatttttatatataaattttatatataaatataaatatataaatatatatttatattttatattatataatatatttatattttatattatatatttttatattatattatataaatatattatatttttatattatattatataaatatattttatattatatattatgtattatatattttatatattacatatattatatatttatataatatattatataaatatatgttttatatatttatatattatataaatatatattttatattatatataatatacttttacataatataatatatatatttttcttgagacagggtctcattctgtcgcccaggctgtcgcccaggctggagtgcagtggcgcgattttggctcactgcaacctctgcttccggggttcaagtgatcctcccacctcagcctcctgagtagctaggactataggcatgagccccacaactggctaatttttgtattttttgtaaggatggtctggaactcccaggctcaagtgatccacctgcctcagcctcccaaagtgttgggatcacaggtatgaaccaccatgccagctagttatctttttatttacttctagtgatcacattgtggtgagaaactgtattcggtatgataccaatcttttgaaacttgtggtctcatatgtgaaaattttataactgttccttgtgtgtttgaaaaatataaggatgaagcggctgttacatacagttaagtgtgatattcaaagaggttaaaaattcaggccaggcacagtggttcacacttataatcccagctctttgggaggctgaggtgggtggatcacctgaggtcaggagttcaagaccagcctgactaacatggtgaaacctcatctctactaaaaatacaaaattagccgagcgtggtggtgcatgcctgtaatcccggctacttgggaggctgaggcaggagaattgcttgaacctgggagctggaggttgcattcaggcaagatcgcgccattgcagtccagcctggacaacaagagtgaaactctgtctcaaaaaaaaaaaaaaaaaaaaagaaaagaaaagaaaattcagtggtaatataaattaacataaataaaatttaaaaacattttctaaataaattaacctatatagattataaaaatgctcaccaggtgataaccattgtagctcaaattgttcattaaatcattctagtaattttcaatcatttattaatttttggaaattgtagccataatcttttatttgacacagatgcccttgtctgaaccatgaattgacataggaaactagataaagcccttctaagaatgtccacattaaatttatagtcattaaataacttgtagtcatgatacgttaaaaaaaatcacactttttaaaattttttgtagagacaaggtctccctatgttgccccagctggtcttgaactcgagctcaagcaatcctccaccttcagcctcccaaagtgctaggattataggcatgagctgccatacctggcctaaaaaaaagaaatcactcttaacatcaacagaattgttcatgggagctgaatcctctttttggcttttgctgaagtaacagtaagtatattttaaaatgtttttagcccttcaaatgcttgctgttagtttcatatagtcaatatttgtttaaatatattaataactaagtcacaaaaataatttattgatatacttaattatattaaacctaatccctcagtccaggtgagaggtaacgtaacacagcagttaacagcatacaccaaggtacagaaccttcatttaataaactttctgcttcttaattcccccaactaaatgtgtctggtagacagaaaaagatgtattttggtagtcattttcatttataacatgagtgtcattaatgcctactgtaggcaggtattcattgggtgttggcacacttatcctatctaaataatggggaaattaaacaagaatgataaaactaaggatgtgcatcccagaagttattcatccataaaccatccccacaggcctcgatcatctgctgtagattctatcctgccatgggaatgtatactgtgccaagagaattaatatattttgatggcaactgcggtagtacagtactattactctcatttgactgctcttctttctggatctcccggggctgtagttcccaaaggggccatgtgagagtgatatgagaaaggtaggcagccctactcttagggaagccagatggtcactgggcctatggatttttttgtgtgttggaggttgccaggcacgggtgaggagtaattagaatggctgctgccctgtagttctccagtgagatgtttgctgacagtctcttgctgtcctagttcttaactctttagttgctatataattggttactataggaagtcccaaggaaggcgatgaagcattaagatgacacttaacaggcttgggacagtaactgttcaaccactatggacatatcaatattttaacaactagtatagctgaaccagtatcagctgaatagcaggcctgaatgtagtctacgaatgccattaagagtaagattttaagaggtactgttcttttatttattttttaattttattttattttttgcaagacagggtctctgttgcccaggctggagtgcagtggcacaatcctggttcactgcagcctccaccttccgagctcaagtggtcctcctgcctcagccacctgagtagctgggacaaagggacacgtcaccacaaccagctaatttttgtactttttgtagagacagggtctccttatgttgcccagggtggtctcaaactcctgggctcaagtgatccacctgccttggcttcccaaaatgttgggattgtaggcgtgagccactgcgccaagctactctttgtcttttaattagaatatttagtaccttatagttattgcaactagtaatgtttggatttattttcagctattctttgtgctttttatttattatatcttgtctttttttcttttcctttcttgccttcttttggaatttttttctcattctgtactttttcttgtactagtctggaaattataatctttcttgtcttttggttccttgaaaattttaaatacctattaaagcccaaagttaacatatattattatccccccaaatacataaaaacttagaatgtcacttatcatttatttttattttactttgagatggagtctcactctgtcacccaggctggagtgcagtgatgtgatctccgctcactgcaacctctgcctcccaggttcaagtgattttcctgcctcagcctcccaagtagctgagattacaggtgtatgccaccacaccaggctaatttttttgtatttttagtagagacagggtttcatcaggttggccaggctggtctcacactcctgacctcaagtgatccgcccgcctcggcctcccaaagtgctgggattacaggcataaaccaccacacccggcctcacttcataatttatatgctattattgtcttctatttttgttccatctctattaatcccaaaagacattatcagattaacatgtacatacatatttaacactttttgttcttcattccttctagcttctcagaccttccgtttgaaaataatttccttctctctgaacttagaattcctttattggaggtctgctggcaaacttactcagctttccttgtctgaatatgtatttatttcatctttgttcttggcaaggacaaagaacctatgtttgttgggtataaatctagactgagggttttttcctagcatattgaaataattaccactgtctctatatttatattatggttgaagactaattggctatcactctcatagttgctcctttgaggccttttttctctacttttttttttttaaatggagttttgctcttgttgcccaggctggagtgcagtggtacggtcttggctcaccgcaagctctacctcccaagttcaagcgattctcctgcctcagcctcctgagtagctgggattacaggcatgcaccaccacgctcggctagttttgtatttttagtagagacagggtttctccatgttggtcaggctggtctcgaactcccaacctcaggtgatccacccacctcagcctccgaaagtgctgggattacaggcgtgagccaccgtacccggcccctttttcctctgtcttttaagattttatatttattgtcccacagtttcactacaatatgtctagaaagaattcttgcttgggtttgttgggcttcttaaatcatggcttggtgcctttcttcaattctggaaagttctcagctattatgtcttcaaatagtcccccttacaccatatgatatgcttatatggtataagcgtaccatatagttagccagagttcctgaagaaactgggactattttctttaggaactctggctaactatatggtatgctttttctctctatgctctgtgttactaaatctccttttcatattttcaatctctgtgttttccaggtctgtattctagttagtttctttgcttctattttccaatatgtgaattatctctatagctgtgcctaatgtgttctcatggaggacagtttgacagggtctgacatactataatttattaacattatcaattttactttttcaaaatgtcattttagaaggtgatacacttattttgacaatgtttctatcacttaaaacattttttgaattctttagaaaataccttctaacccatttatcttttttattgccaaattccttatattgtggtctctattaaattcataattttaatttttacattctgtgtcaccccctccttctctgtattgagaagtccttgagggtgacagtggttatgctacctggtaagctgatttaactcatatttaactgaaagatatgagaaattacctcatttaacacggatatgtcatctatctgtaaaattactttaagtcctacacaaatgtagggcatactagatgaagtaagaagactgaaaaattaaaacactgaagtattttcactcatcaccctgataaacatgaaaaagaatggcagtatgcagtgttgccaagggtatgaggagacaggcatgtgtctagaatgtaggaatcagaatatagtaatgagaattagtatgatctttgcagagggcaatttaacaatagatataaaaatcttcataacaataactcattctagggatttatcctaaagatataaatataaaatatttgttcaaagaggttttatttaaactaatgaaaaatgttaatgttgtagaaatatatttattaacataagcagttcacaatttactgtaagaaaaaaagcaagctacaaaacagtgattccatgtttatattaaaataaacatacacaaattaaaaatttccttagatatccatttaatctctgggatcataagcaatgtttaggtattttttgctcatttattgcctaggttttacacaatgagcatatatgttaattgtgtaatttaaaattatggaattaagtgcaagagttcctaaccaccttttacaaaactgttatgagaaaatacattctagattcaaacaaaaactaagcaatatatcccttattctaacagctctaaaatctgttcttctcattatactcccacctaaaatcccacatccaaaaagtagaaatagctgcttctgaattcctgaaagtatcggtaggaggttgggaggagaggggccgggatatgaagagagaaactgaatatttgaggacagactgttcgtgttttgagggaaactttaggaatagggcttggctgaaggaaggaggctgcgaggttccatgaataagtttcagcaaaatagtttctcctctcaccagttttccaccttattcaggtgtgcatccactgctacatgctccaaccaattgctgttgagaccccagagaccccagcaccacgtgtgattaggaagcgcttccatcattgaaatggaatagagtctacttgctcacagtaactcctgtttctattcctttgctccttccttagcaacttcaggtctttcttcagtaaaattttttgctttgtaaacctattttttttcacctcctgtaacatgatatgctgcccttctacgacctttgacataccaatcatctccatctgaaatacttctatccctttcccaaccctatcttgactaatttatttcgtactcatttttattttcatttaggtgccacttcctcagggaatccgtgaacacagtgtccataacagattccttcaagactttatctcaattaacaaatatattttatgcattatttagtaaggctatctactatctagttgaaccattaagtcccaggctcaatgaaaacagtgccattagctggttttgctcagcatggttactcctgcatttggaacatagcaagtgctcaacaaatatacgccgaatgagagaatgaatgaatgaacaactgagtaaacaactagcaaccgagaggcttggtggggtaagaattacattaactatgtcacctcatggtggaactgtgcacattttttcttttgatggcggacttgtgtactgacaagacaaagttttaaatagatacgattttggaaagttccctttaaagcaaagccatacaataaatatttaatcagccaagaaaaaggctgtagtctagcctggggacttcacaaatgacccaaatcatgagagccacgtctctacagtgtcttagtactgtatcttccttgagcaaaggaacgcacttgccccatcatggcaagttcaggtacagagtgcaaggaatctacagctttcctaccccgacacaggtttaggtaggaaaacgcgagcctaggatgatggggagaaagcgggcatttattcaaaatgtatttactgagcacctactgtgtaccagaaagccctagttgtgggctggctctgacaggtccgctgtgtagcttcgggcatttctccttcacagagcccaagtcctgaaggcgagcaagtggggccccgcctgcctgcctcaaaaagctgggctggggattccaagggcgagaatgcgcttcagaaagtgccaggaggcacgaaggccagcggccccaaacggcctcgctaacctcggcccgggcgcggggagcgagcccaggacggccgtccgctggcagcagagccgggcggaggcgggcgcccgccctccgaggggccgcgcttacccgtcgggcgagtactcgaggttgaagacggcgccgtgggtgcgggtgctgaggtacaccgagtccgcggggtggatggaaccgtagaggctagtcatggtgcgaaaattgtcccgcgccgggtccacgaacagcccgcggcccaggctgcgctctttcagccacccgaacagcctagcgccagggccgcccaggcccgcgccgaggccgtgtcggccccggctcttggccctgcagtctggcccgggccgccggcacggaggggagggaggtgacggctctcccggggcggaggcagttgaggactccggagctccaggcagccctagctctccggagcgcggggccggggacagcgatggggcgccggggcggcgagggcttcgggcgggtggagggggatgggtcgcatcagccccgggatgtagtggcgagggcggcccggtggctgctgcctgcccctcgtggggcgtcggctcctcagccccggctccggccgatccgtcccctccagggctatggggcccaaagggaaacatgatcaacgcccccgccccccgctccgggccactgccccgccggccgacacctcagtgcccctgttcagctgccacttccggcgtgcagcggcctaaccccaccggctggaaacccgcgccgcccctcggccaccgtccgccggggaccgggaaagctgagacaccgccgggtttggggcgccgcagtcccgggaacggaggtagggagcgagtagttacctgtgtgagcgactgagcatctgggcacctgatctgggtggcagagtcggtctgtagttgtcagtgaccggtggccgcgtgcctggggatgagtggcctgaccagtcagtcctgtgaggctgagtatgtactggtgtctccactttacactgggatcagcgagggattaagaattagtgcattacgtgcaggccacacacaataggtgacatgccactctttttttttttttttttttccgagatggagtctcgcgctgtcgcccaggctggagtgcagtggcgcgatctcggctcactgcaacctccgtctcccgggttcaagcaattctctgccccagcctcccgagcagctgggattacaggcgcccaccaccacgcccggctaattttttgtattttttagtagagatagggtttcaccatcttggcctggctggtcttgaacctcgtgatccacccgcctcggcctcccgaagtgctgggattacaggcatgagccaccgcgcctggccagcatgcccaactcttaaaggcacaacaagttcagggtgaccacaggcagcttcttccaaaacctatttgtcacaaggcaaaggagagactgagaggaaacaggtttggatgtgctacccaaggaatggctgagatagccagtctgtgtatctgggcttaaatgaaagatggcaaataggtgatagttacttttctgggtcaacttgactgggctaacagatgcccagatagcctggaaaaccattatttctgtgtgtgcctgtgagggtgtttccaggacagattagcatttgaatcaatagaagatctgccctcaccattgtggacaggcatcatcctattcattaaagactgaaaaggaacaaaaaggcagaagggtgatttaactttctcttaagttggtacatccatctcctgcccttagacatcaaaactcggttctgcgggctttggacttggggactcatcgtcagttttcaggccttcagtcttggaccgggagttataccattagctcctctgattctcacaccttcagactcagactgaattacaccaccagatttcctggttctccagcttgcagactgcagatcatgggactcctctacaatgatatgaaccaattcccatattaaatgttctcttatatctatatctcctattggttctacttctctggagaccccctggatgggtccaatctactgtagcagcctacttgcctggcattcacactcttcatgtgtatgccagcacgtatattctactgaacccatcctagaagtcctaggctgtcgaattttgtagctgttacttagctttccttgcctactagccggggtaggacaactatttgagtaaccaggctatagattagccactggtccatgaggctgccagaccaaaagtctttgcccatacagactcatgctcttgggaatttgaattgggaaatcagaagtgaggcagttggccatgatggttgggattgaaaagtcataaggcagagtgaggccgctggagtcctgagcaaaccaaaggagtaagagaaatcatgagaaagcagcagccatgagagaacagacttgggatagacggtgagaaagaaagttgatggtaggaggagatacagatacataaaaagagacagactcagaacaggttagacttgttcttggcagagtccccctagggtcttcctgcagagtcccttgaggtaccagaatgatggctgctcaatttcagtttcagtttcctgtgggatgatcacttgatttcacaatacctgaaccaggacttatgcactgacaaaaagaatcaagggccagacacagtggctcacacctgtaatctcagtgctttgggaggccaaggtaggaggatcttttttttttttttcagggtctcactctgttgaccaggatggagtacagtaatacagtcatggctcactgcagcctcaacctcccaagctcaagcagcaggaagatcttttgagggtaaggagtttgagaccagcctgggcaacatcatgaaactctgtctctctatgaaaaataacaaaatcattccggtgtggtgatgcatgcttgtagtcctagctgctcggaaggctgagccaggaggatcccttgagcccaggagttcaaggttacagtgagctgtgatcaccctgcacttcagcctgttgcacttcagcctgagcaacagagtgagaccccatctcaaaaattaaaaaaaagaattggcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactctggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaagaattggaatgacaaccaagaaaacaaatgtgtcctttcaaccagggagccttctgtagcccaaagaaaacaatgtactcaaggagtaaagtgatcctatcatataagcttattgaaaaataaaaagcaaacattcatataatgtttagtgtatgcctaatattatgctgagtaaagtgatcctatcatataagcttattgaaaaataaaaagcaaatgttcatataatgtttagtatatgcctaatattatgctgagttaagtgatcctatcatataagcttattgaaaaataataagcaaacattcatataatgtttagtatgtgcctaatattatgctaagctggttcatatatattaactcaaaactcaaggtatgttggtacgattattatccccattttagagatgagaaaacacagacacaaaaaagaaaagtcagcctgagagtggtaaagccaggattcaaatccaggcaatctagctccaggttccatgctcgtaaccaggtgctacacacacatttgtagattggcttggatctatagctatcgctgtacatacaagctccttgccaaggatggcaactcaatagtattttttaaaaacctccaaatctaagccaatctacaaatatcaggtctggctccccttttcttctgaacacttttaaattctgaacctttgaataactgtaatcccatgaaaaagaacaacttccatttgttgagtaagtgcttcaccaggcttattggtaggagctttgcaagcattgtctctaaatttccctttactgggggcagccataacttggcaactacgaggaaatgcaagctcagtattgccacagctacagatttttcaaaaaatgccacatgtggaagttcaaaatgaggcctgctgtgggctcaatgatgccacaagaaataggacataggatgatatacctaacacagcaaggagatgccttgtgtggccatcagtagatctttgagaaaagacagagtcactctgttttacaggcgtgagccactgtgcccagcctcatattctctttatttaagaagataccggaggttatggacctctagcaaaatggacaggtaaagcaagaaagtggaataaaagtgatctaagtggatctaagaaggagagcagtgcaggaaggtataaaagacaggtgtacaaaaagggagggaaatatgacacatgctacaacgtgtatgaaccttgagaatattatgccaagtgaaatcagccagtcacgaaaggatatatatactgtatgtttccacttctatgcagtacctagagtcgtcaaattcacagagacagaaagaagaatggtggatgccaggcactagggtgaggtggggatggggaggtattgtttcatgggtacagaatttcagttttgcaagatgagaagagttctggagatggatggtggtgatggctgcacaacagtatgaatacacttaacactgtgtatgtactgaatgtacatgtaaaaattgttaagatgataaattttgttatgcatattttaccacaattaaagaaaagacagctgtgcagcaggcctgaagagcagcccccccaaagtgggaggagcacagagtgggaagtctccagaggaaaaatggaaatggaatgttgcaatctattaaggcgaggcaaaagactccaatgccagaatagtggaagaaattaacaaagtatatagaataacaaacaatggactgaaacgaggcaatcaccaactccatgaaaaataaaggattgcataaaatgtacaatctgtcaaggcagataacaatatttgcactggtaatattgtaaaaaatggcttctgatttaaccagaaattgtgctgtaactatgccgtgtgttagcaaagcgtggagagggagggatgaagagtgtggaaataggaagagccaaaaccacatctaccttgtcaggaagtcaacacattctcttaaaattaagaaatcaagcaatatcagtgtattatatttaaacattgaggtaaaatagcagagaaaagagctgtagatgaaggtggttgtcttttcggatgggaactggagggtgcaatgggtaggaattttttcatcttctcaaactgaaattcgtatacttaggcatgaagtcccatttccacccttcaacccccactcccaagcacctggcatcccctgctctttttcagaagccttgtagactcaaaattacctgcactatttaggcgaaaactaaaagtggatattttctaaggtgtaagtcatgttactgtttttcctcaggtatactgttttcagcctagagcaaaagtaaacttttaagtggtctctgcagggatatctgacattaaatgttcataaagctggagaaatacctagcaagtttaaaagttagtggagctttccctggtacagaaactccttcacagaattcacactatgcctttgatataccggtttctaggttcttgggatctgagtgtgtatgtgcatttgcacaaatttggtagtctgaatctggtgtgtttgatgctatgacaaattatggacagtgagctatggaaacacagatgagggacagttcagcagagggtcagaagatactccctggaggagctggtgatcaagccagtttttaaggagaggttaagcagagggagggagactggattgttaagcagggtgcatacatggcatgaagaatggcacagatcagggcatgtttgggaaatttacaagggatttggtgttgctcaagaaatggaagtcagggagaagcaggatgaggtggcaaggtgagcagaggagagggtcacagagagtcttttttccctgtaggtgatacgatgctctcagagggctttcaggcaggagaaaggcatggtcaaagctgtgtttgttatttgttttgcaacaagtttttccatatatttgccccatcaggctgaattgtcatcaagaagacacctattttgcctgtctccatattatgtttttagttatgaaaaattttcaaacaaaattagagagaagagtatttaaaaaaataactatatgcccatcatctagattccattattaggattttgccacattcaattcatctctctctctctctcctttttctgtgaaaataattctttattgtggtaaaatatatataaacataaaattgaccattttaatcatttttagatatacagttcagtgatattaggtacattcacattgttgtgcatccatcaccaccatccatatccagaactttttcatcttcccagactgaaactctgtacccgtgaaacaatgactctcactgacccgtctctccagcctctggcaactaaatatcaactttctatctccatggtttgaaggcatttcatgtaaatggaataatacaatatgtggccttttacttagcgtaatattttctagattaattttacattgtagcacatttagtcccttttaggtttaaataatattctattgtatgatataccatgctttgtttattcacttatcagttgctggacatttgcattacttatacttttggctattattaatcattatgctatgaacattcatgtctaagtttttgtgtaaacataagctttcaattttcttgggtatatcctagaagtagaattgtctgcctgcctttctttctttctcccttcccttccctcccctcccctctctttcctcctccctcccccccttccattcccctctcttcccctcccttcccctcccgtcccttctcttttcagagatggggtctctgttactcaggctgatctcaaactcttgggctcaagtgatcatcctgcccaggcttctacagtgctgggattacaggcataagccaccacacccctggctggaatagctatgttatatggtaactttatgtttaactttttaagaagctgcaaaactgtttttcagttttcaaagtggctgtaccattttataattctaccagcaagatgagtgttctgaaatttctatatccacaacactggttataatgtctttttgattgtagccatcctagtggaggtgaagtgatatctcattgtgatttaatttgaatttcccagatgactaatgatactgagtatcttttcatatgcttcttggttgttcatatatcttctttgaataaatgtctgtttggatccttggcccacctttaaattgggtcatctatctttttattattgagtagtaaagttctttatatattctagatacatgtcccttatcagacatataatttttaaatattttctcctattcagtgagttatctgttctaattttgataaagtcagatttttcaattttttcctgaatgtgcttctggtggtataatatctaagaaaccactgtcaaatccaaggtcacaaagatttgcctctgcattttcttctaagagttttataattttagttctgagatttaggcctttcaatcatttaatgtttttatatagtttaagatagggatccaacttcattcttttgcatgtgtatatccagttgtgcttacaccatgtattgaaaacattattctttccccattgaattgtcttggcacctgtgtaaaaaatcagctgattgtaagcataaagggttttaaaaaaatattttttcccatctctcaacttttagctgaagatgaagttttatttctgtatcttaattctattccattaatctatatctatccttatacctatacaacattgtcttgattactgtagccttgtagtaagttttgcaatcagaaatataagttattttgttctcacaaaagaagaactttgttcttcttcaagattattttggctattctgagtctcttgaatttccatacaaactttaggagcaatttgtcattttttgcaatgaaggcagttgggattttgagaaaaattggattgaatctgtatttcaattttgggaatagtgttatcttagcaatttttttttaaattattgttatttgtggagatatggtctcactttgttgcctagggtggtcaggaactcctgggctcaagcagtcatcctcccatgacctcctattaataatattaaatcatctgaaccatgaaaatgggatggggtgccttttcaattatttagatctttgttaatttcctttaataatattttgtagttttcagagtttaagtttgacatttctgaccgggcacaatggctcatgcctgcaatcccaacactttgggaggctgaatgtgaggattgcttgagcccagaagttcaaaatcaggctgagcaacatagtgagactcccatctctacaaattaaaaaaaaaaaaaaaaagtttgacatttcttttgttgaattaattcccaaatattttcttttctttgatgctatatagtggaattatttttgaagttttatttttgggttgttcatttcaagggtacagaaatataattaatttttgtatatcctataaacttgctgaacttgttagtgttagttctaatggttttgtgtgtgtgtgtgtgtttgtgtgggtgggtgggtgccttaggattttctatataccagatcacatcacgtgcaaatatagatggttttaatttttcctttcctatctagatatcttttattgcttttacttaccaaattaccctggacagaacccccagtataatgttgaatggaaatggcaagagcagacttccttgtcttattcccgatcttaagtgcaaagctttcagtctttcactattaagtgttatctgtgggtttttcatagatgccttttatcaaatggaggaggttcttttctaatcttatttattgaggtttggttttgtttttgtttttaaatcacgacagggtgttagacattctcgaacgctttttctgcatctattgagatggcataatacattaattgatttcagatgttaaaagaccttgcatacttgggattaattccacttggtcacagtatacagtcctttctatatgttgctggattcagtttgctagtgttttgttgaagatttctgtgtctgtattcataaaggatattgattcataaaggaaaaggatagtttccttttcctgtgatgtctttagttttgatatcagggtaatactagcctcatcaaatgaattgggatgtgttccctcctcttctgttttttgtaagagtttgtgataactggtattgattcttatttaaatgtttggtatagttcaccagtgaagccatctgggaatgggcagactctaccttattgctattactgatgagtttgatattaccacctgatatggtttggctgtgtccccacacaaatctcatcttgaattgtaactcccacaattcccatgtgtcatgggaggaacctggtgggaggtgattgaattatggggtagatctttcctgtgctgttctcagaatagtgaataagtctcacaagattggatggttttaaaaatgggagtttccctgcacaagctctctatttgcctgctaccatccatgacttgctcctccttgccttccgccatgattgtgaggcctcccctgccatgtggaactgtaagtccattaaacctctttttcttcccagtcttgggtatgtctttatcaacagcatgaaaatggactaatacaccacctcatgagaccttgtgccagttatcaatgtattgtctctcaggtccaaattcatccttcactgactgctctgagaaaatggatctgagccttaaattttttttcctttgttctctttcgtgatgatatgctttataggtagaaggccctgaagaggcgtttcaggaggaatgggttttgcttcctggtccagttgtgctcactggcacacttctgcagcacagcagcttctccagcatctgttcctgctttgattggtggccagaaacactcagcagccagcagtgttccttagcaccctattgggcagttttatagcagaggcttccaggagacccctccccatgaatacgtttcctcagcaacgtaaaagtgccagaaaattctagagggtggatttataggaagttccactggaagattcccagtgacttcttgccatttaatgagccacagccacactctcttcaaaagggtctcaatctgccctggctggaggcgagaggctcctctttgggaactctatcacagcattagagtagcagctgttccttatatctgctattgctatactctttaaagctctctagttcttattagccagtgcttcattattctaataccctgttatagctaataattcctcatatattaaactgtctttattcaaatgagcatggtttgtcttctgattagaccttgactgatgaagatatcttaagcttttccatggatccatctatgcctggaccttgtatatagaaggaattcaatgaatacagtcccttaatagcatcatgacacacagttttcttatgtagttgtcacaatttcaggccctttcatccttacatttattgagcagttattgtctgtgttcaggaatcttgctgtgtggcaggagataagaggagagaatcagtagctagaagaatacaacagctaaagtggccttggtgaatagtccagaatgataaaaaacttagatcactaaaaaaaattgcatgagatgacactgcagagataaggtagagtcagatgatgacaggccttgacttctattgggacaggcagtttgctgtggccttgagcatctctgcatgtgcttgcgaagtatgccaaacacaaggcctaactttcccctaatactgaaccatttctagctagtcacatcggcatttaactaggttaagatgaccacagcataactaccatacaacagctcactccctcagggaaggaggctggttggtttgccacttgctacaaaagatgctaggcccttagccctggatccctcagtcatggtgcaaaccactgcatgtgcaaccactgtccgggcccattgcatttactccataggacttgaggacaggccaaccagtgctaccttgctggtactcctactgtatgctgtgttgaataataaatttcttcatctgatccaccaaatctcatctacattggtaccaatggagttgtggctggtgaacctgctttcttgcttagtcgtctccgttggagtcttgttatttcttgctattctctaggaggttggggctcttctctaacaaagggtgccatgacacaggcacacacacacactacaaaatgaaaataaacatgaactagaaagatgtttccttattcaagaaatgcagataaatggcaaagctgttggaaaccagaaaaccatgtaattttgagtatttaaaatcaatcctgtattgtgatacactaagaccaaacttgaatgttattccacataagaatctagccaacagaatgtagttcagatttgggaaatgatggtgaggaaactatattttatggaattgctaatacatttaaaacagtagttggtaagaaaaaagcgtgttctgggccaggtgtggcggctcacgcctgtaatcccagtactttgggaggccgagatgggcggattacctgaggtcaggagttcgagaccagcctggccaatgtggcgaaaccccgtctctactaaaaatacaaaaattagccgggagtggtgatgtgtgcctgtagtcccaactacttgcggggctgaggcaggagaatcgcttgaacctgggaggcggaggttgcagtgagccaagatcaagtcactgcactccagcgtgggcaacagaccaagactccgtctcaaaaaaaaaaaaaaagtgttcttttactttttacaataaatcctgtttgagaagttatgatccttgtgtaaaaatatctgtagcaagtagtctgtcatttgtgcagtgataactgtgggcatttatgtttttagattaaatcctgtatttgaataaagatgttaacaatactttcatgggcttttatggttaatttcagtatgtaaattagcatgtagttcatttataattttagaaactagtaaagtaaaaaatattaaagattcactcaaattattacttcctttgtaacacctatcctaacccctgccttccttccatgtagagacaactatttcatcctctgtaccctcagggctgacactctattcaggttgttgcatccaccttaacacttgctatcttcatgtggagagagtgaactcccccaagggcagggaccaggactcagccgcctccccagctcaattcctggctgaaagcaaatgctcaactagtgttggttaaaaggaacaaatgcccaacctcaccagtcggtaaagaaaagcaaccgtgagatgccacgtttctaacttctaaactagcaaagattagttatgaagaggaagttctgggaggagtccagaaagctacactctggtccaacctttccaaaggtcaatttggcaatttccccatatgtcatactaatgttgtgtaaccccaaattcagtctcatgtacctgatgcagagctgaagccaaacgctaagacacaggtgcttggagatagagaaaggtttgttcaattgggccaaagcaagaaggcggaagagcaagatctctcaaatgttacttaacaaagagatgacagcaggcgtttttatggggtagggtgtgagggagggtttccgggaacagaggggaaaagtctgtgcctctacagtctcagataaaactttgagcaaccagacttatgggtgtcagcagctggtcaaaaagtccttaatggcattcattccttctgcaaaatattttcatgaccctgaagttatctctcctgctagacaaagaaacaggacaacagcagtttataattatattgtgggaacaagagatattgggcaaaacgggagcgcttactatgtgcatgcaggcaagggcctgatcagaattttcactacggccgggcgcggtggctaacgtccggaatcccagcactttgggaggccgaggcaggcggatcatttgaggttaggagtttgagaccagcctggccaacatggcgaaaccccctctctactaaaaatacaaaagttagccagtcatggtggtgcatgcctgtaatcccagctacttgggaggctgaggcaagagaatcgcttgaatttaggaggtggaggttgcagtgagccgacatcgtaccactgcactccagtctgggcggcagagcgagactttgcctcaaaaacaaaaaacaaaacaaaacagaaaaaaaaaaaacaccaaacggaattttcaatacttcagttactaaaaatgccagactacttaaatctcaaggggcctggttacactccgaatggggagacgtaggccagaggcactggaaaggtgagcagtctcgactgcttcggctcgaaaccagtaagcctctgaagagaacgggcgtaatccacctcgcgattggcaaggaaacacacgcacccgcagagggcaaagcgcgcacgccgcctgcaccgggctctggcctcctctgcattccccagtcgttgcacttttcccacttttataaccaggagaggaggcacgcgctgcccgaaaacgcgaaccgcgacccatgggacgctagaaccgacccgcgcgccctcgacggcttgaagccgggttcgagacactcgttcgcggcctagggctcccgccgcctaggaccgggtgctcactctcgacagggcgcaagaccgccaggtggcgaaacacctcctcggttgcgcgcggtctggtgggcaggctgcggtcccgcgtgccccacccgctctgggcgtgtcagggtggtaggtgttcaggagtggagccccgcccagccaccgccttcgggtcccggcctccctgtttcatctgccttgacccgcgagagagctacaccgctcgccacgtgcggcctccacagggtagtgggcctcataggactcagccgctagatctgggccgagtttcctccagagacttcactaccgacatggggtgtatcaaagacggtccagagaacatttaccgacctgcctgtttgcctggccggaatgtgaggtccttgagcgcccttgagccatggccttgggcctgccaagattgaggcaggcgtggtcaccgaatacttctggagtggggaagagagcacaatttacgctgtccctgccacaggagctcccactcttgccagggaaactaacctggaggtgggagctccttttatttgttgacctttttttatacccaggggaaaatggcttgccaaatttggagggtgtgttagagatgatctgtcttaatcatcctaaaaaatctaaaaattcggccgggcttggtggctcatgcctgtaatcccagtactttgggaggccaaagtgggcctatcgcttgaggtcaggcgttcaagaccagcctggccagcatggtgaaacgctgtctctactaaaaatacaaaaattagccaggtgcggtggtgcactcctgtaatcctagctactcgggagcctgaggcaggagaattgcttgaacctgggaggcggaggttgcagtgagccgagatggtgccactgtagtccagcctgggcgacagagcgagactccgtctaaaaaaaaaaatctaaaaattacgttggaagcaggtgcctcaaagagatgagcagtagaaagggagggccgctaaaggcaatcggtcagtcacggcctcccagaccctaggaattctaccactgctggagaatctgatcaagcactaattgaaggttcgagttgacagagaaaacggtgatttaaaatagaacccccaaagtcagatagatgattggaatctctttgggtttggaattcaactgcttctcacgtgcgcaactaagtgtgctccagggaaatttgagttactgatattccaggccatgtagggctatcggaagcatgtgaaatatgtatatttgcagggggaaaaagtctagggagaaatacacaccaaaggaatacattcgttcattcatcaggtattacctatttcatgccacaccttgggctctaaagaatcagaactacagtgtagcaagggagaaaaacgggcaagattaaaacatcgtttattttcttcttttatttttctctgtgttttctaaatgtgactagatctctaacaaccaagaaggttttatttattttgaaaaaaactacttttcctgttaaaaggtcagccactcttctgagggcggagtcggaaagaaggtcccatgaacccacctagcgtccaatttcccttttttttttttttttgacagggtctcactctgtcctccagactggagtgcagtggcaccatctaggctcactgtaacctccgcctcctaggttcaagtgattctcctgtctcagccttccgagtagctgggattacacgtgcgtgccaccacgcccggctaatttttgtatttttagtagagacagggtttcaccatggtggccaggctggtcttgaactcctgacctcaaatgatccacccgcctcggcctcccaaacttctgggattacaggcgtgagccaccgcgcccggccccagcgtccaattttcaaagcccctctgctcagcttccagagatcccaagaaactcttaagtggaagtatctcgtatccccacgatgcgaccggtcacaaaacacgcgacccgagacactggaagtggaggcttttcgatggaccaagctgcgcggttttcataccgacccgcggccaggctgtcagataggtggccggccacaatcactgccaccttggacagggacccgtgagctgacggccatcaagcttcataaactggtccgaatccaacggaccgctactgccggaaacggaaagtcctcaagggcgggtgttggaagcggagcggaagcggaaggcgggtaccggaaacggtgtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcgggtgagctgggactccggaggggtggtgcggcagtgagagtggtagccctgctttgagaagacctcccaaaagaagagagggaccctgaggccctcttttgttcaggcaaacctagagccaccgtagtcttgtgcccacttctgcatgtcctttagagggaccgtgaacaataggaacatagcctgagaagggcgaccaggagagaaaaacgtttggagaccgtgagtcatgattatagtcttcaaaaccccacagcaggcctgccgtttggagtctcagagggcaggactaggctcaatgagtggatgtcatagggagttaatttctcctagaacaggtaagaatttcatatagaaaaaattgtctatggaatgggcttccttggttgtaaggattcctttgccactggacttatgccacaaagctagagacttactggttggggtgcctaagagataatggagtttggactcaattaacagactaccagaagctgcacacccggcactttatgaagtgattttcttttaccgaaagtggcatttgatcagatttctctttaatgacaataaagtaaccacaaaggacttgctgaaggtatcttccaatggtatcttgtcatttatggctgttttttcattctgtttctttttgtagtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggtaattacgggagcctttggtttcaaagaaacaaacatccattccctagaacactcacatatccagaaggctatctgaattgtctccaaagcatgacctagatctctgagcttgtatataattgccccaggctccaagagtttcttcagatgctccaggatcagagccacataattattattattattttttacatttacaatttattttacattggctacatttgttcttgggatgtttcatttctactgagttgaaaggttgtatctatcatcgccattatttgttatgtccatatcctctggacaaggatgtctgctgtaggcttagaggagggacaggtggtgcaaattgacattatcagctatccatccatcctggctgtaggtcctaggagctgatagaggagtaatattgttaccttgggttttcaatttgagcttttcaggtagcatagccacactcttcttgtctatccagcctgaaatttagtgatttcttcacctcttctcattcacttctcatgcaaatttagttgcttaatcctattttgatcctatttgattctgtctctgatctttggcatgtccgtccctttatctccacaagttcaggcttcagctccctcttgactggtctcagtcacttcttcattaatccctgcctccacgcttttacctcaccatccaggattttgagagctgacatcctcacacggtcactttctcgaaaagacaagattctccaaaatctacagaattccttggcattacactccaggtgtctttcctcatccctaattatatccttcatacagccatactcaaatcacaccaaacgccattaaactcaatttcctgcccttatttgcacatgctgttcccactgtcttgattgcactatcccttcgcaccctatggaacacattctcattctttgagacgtaggctaaacatgaccacctctgtaaagccatctctagttgccacttttctcgtatctttgctctagcacttactggattgagccttgactgaggtttgtttatatgtacctccccactgccctccaagaccaaatgcttctgaaaagcagagaatgttttgttcctttctagtttacatagtcaccaacaaacagtaggtacttaatacgttttgttgagtgaacagaatgagttcactctccatttcctcagtttcgtccctttgaagtttagctctatgaggtttttaagtaaatcctgcagggagaagtgtcagtgaattattgtttgattttgctttgaataatttgcatgccggagttccttcctttctctgtaaatctgtaattctctagggtagtgcgacctaatataactttctacagtgatgctgttttgtatctgcactgattagtatggtagccactagctgttgagcacttgaaatgtggctaatgcaactcaggaaattaattttaaatacctaattttaatttaaatgtaagtttaaacaattggctatctaccatattggacagtgcaatcctagtgttctctggccttgagatggctcctcgtctgtgatttcctgattggtgaaagggaatgatacatgtgttcctttttttccccaagactcaactccaaagtgactgtgggaatcctatagtgcagtcagtcccttagccacagaactgtaggtggctggcattgatgcctgtgagaaagaaccaatagtagcacctgtagtttgctgagaggaaatgaactggtttttaatatcattgtaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagtaagtcctgatgtctgctggcttgactgctttttataattatacattcttggaaagttggttaatcttcaggattcagattctttgtaacgtttgaatttctcctcagagttagaaatcagtatccattttaacacatttggaaactcatgaatttaatcctatcttcttggaaacatatcaaattcagatgtgtttggctgtgtagtttctggtgggctgatacttcatgccttaagctcttactctgtattcatatcttccttcccaggcctgttgcttatttgacttagcccaaatgtgaaaactggcctttcccctgttctgagtcacttgaatacagatgcagtctgcagttgtataaaattatcaattttttctaattatgggggtcacacgcagcttagattgtgatgttcaaggttatgtagacattcacagaaggcttctgacacttggtcatactgaggcatactgaggttcatgctgaggcagattctctttttggtgtttagaactttacccacccaaagctgtgccatattcaggggctttactcctagagccagtgaagttgagagctatcttgtatgcctctccttactacatatcctaaagatctggagaattaagtttggacatcagagaagcatgtttttaaccaagaagcatgttattaaccaagcaccacccttatggtttgaaagagccaatgttcctctccaagtactgaatttaacacaagagaataatatggccaggaaaataagtttaaagtgtcttaacactgtagataaaaaaagttatgattcccagtctagaattaaagtgctctgaccatctaggggaatgacttttacaaagttggtaacctagggagtttgatttctttgtaaggcatagcccacctctgtgatttctagtatacctttgaacagtgtaaagttccttcttggaagaaaggaggcagcaaatgtcatcacgtgccttgttcttgttgaacagctatggagaactgctcagaaaaggaatcacattctaaaggagactccggacacacctttgccacttcattaaatttcattttcttttctcttcccaccaggctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacagtattagggtttatttggagttaactcccttagtaattgctacagcttccataattaactggaggtcagcagtaaaataattttgtgattataacagtaagccaggttcaccagaggaaatgtggaatacctaagtataaagcagcaaagaaatgtcacctgtagtcccattattcagcgggtgagtatataacaacgaaatactttttcatttaccaagtattgtgttttgcatggattaactcctttattctaactgcagaagacacttatcctcataattgaaactgaggcacagaatttaacttggcctacattctctatattcatcaaattgaaattatagttattatagcttatatgccactttgtaatatacttttgtctacttcaaacagcatgatacatttcacaactttagtcacatatttcatgttacaggatatttttgagttttatcattatataaataacactatgaggatttctgaatccaaatctggccaagtcttattttgctaaaatcatttcctaggagctaagcatagaaaactcttctatgctatttagtatattaaccaaaacctttagaggtaaagagactgccaggtgatccacatcagtgattcttggtttctagacctctgagaatatgtgagatacagatcccctgaagcctatccatagaaagtcctttttggatcaaagagattatagaactctatttgttgataaagaccaaggagcttcgtgtgtttctaatgttttctaaggactggatggtttttagttcaatagcttttaggggtacaagtggttttggattacacggatgaattgtatagtggtgaagtctgagattttggtgtaccagtcacctgagtactatatattgtacccagtatgtagtttatccttcccccttccctgttccgggtctccagtatctgttataccactctgtgtgcttacctgtagcttagctcccacttaaagtgggaacatttggtatttggttttccattcctgagttacttcactaagaataatagcttccaatactatccaagttgctgcaaaagacattttttatggctaatattccatgggatatatataccacactttatccattcattggttgatgggtacttaggttggtcccatatcttttattatgaactgtctagccagtttttaaatagaaaagtactgattaggtgaacagttccttaggaattaaattgtgaaggggaggggacacagcagagaagtaatctgttggttcttttgagatattgaatacatgtcccaaatttgctagctgcttaactagcaagttaacccaaactgtcagagtaactgaagcaaatatgtccaactgggacataaggaacatgagatttgtgtaataagtaggttatctaacgtgttcatgtgtctaacactttctagctattttcaagacagacttaatcaatactgtgtttgctttccaatttaatctgttacaaatacatatgaagaatctagttggtacaggctcagggaggatagaaagataggtacacagatttgtcctgttaggatcctaccattaggaaggattaggaagagaagccctccatgcccatactctgcaagggagaacaaggtaagagccacaggagggaacaaaatgctatggggactcagtagggataggtcagaacaggctggatcctgcaaagcttattactgagctgggcaacaacgagcatgatcagacaaggctggagaaagtcatacaattttatgatgccagtttagtgaatattaaactcttgatgtaaccatttaaacaatttcaagaggtctctcacaaatagatgtacaaaagttgaattagcacgtccaaagccatgtggttttgaggctaattccttgttacataattttttttttttttcccctcgagacaagagtctggctctgtcgcccaggctggatcttggctcactacaacctccgccgcccgggttcaggcgattctcctgcctcagcctcctgagtagctgagactacaggcacgcaccaccatgcccagctaatttttgtatttttagtagagacgaggtttcaccatattagccaggctggtctggaactcctgaccttgtaatccactcacctcagcctcccaaagtgctgggattacaggcgtgagccactgcacccaccacattaactttttattacttaacatatctgagcacttcctgtgagccaggcactatgggagattaaaaagcattaaatgtggtccctgacattattgtgaagctctgagaagatgtcatgcaaagacacttgcctatgtgccactgccaccctctgccctgctctttgggtcaaggtacctccaagcgcctcactcctgcagctgcatttttttttatttattttttttttgagatggagtcttgctctgtcacccaggctggagtgcactggtgaaatctcggctcactgcaaccttcgcctcccgagttcaagtgattctcctgcctcagcctcccaagtagctgggactacaggtatgcgccaccacacctggctaatttttgtattttcagtagagaagggtttcaccatgttggccaggctggtcgtgaactcctgacctcaggtgatctgcccacttcggtctaccaaagtgttggcattacggcgtgagcacctggccacgcagctgcaatcttaggcccatcattccactgagttccgaagaatatagccttttcctgaagaaactcctttcttcaatgcttcaggccagttgtgagtctctaagtaagtggacaggatatcaaacactgttagagagtaaacagaaaacacagtgaccacagagggaaaaaaagaacgagtaaatgaaaaggatgttctgtaatatttcgttcaacaaacctattctgcaccatatgtggtactaaggtcttgcggggagaggcaaggacacaggctctgcttgctctcaaggacctcagcctaccctgaaagatacaggcctatgaatggatagggtgcaacagaaaggaacacagtaaaatgggaaacagaagggctctgctgtggcctgggatggggaagggccaagatgctcctgaactgaaccctgaagatcaaacaggaattcagtggtgagaggttaaaagctgggcattctagatgaaggggacaattttttttttttttttttttttttttttttttttttttgaggcggagttgcactcttgttgctcaggctggagtgcaatggcacgatctcagctcaccgcaacctgcacctcccagattcaagcaattctcttgcctcagcctccagattagctgggattacaggcgcctgccactatgccctgctaatttttgtatttttagtagagacggtgtttctccatgttggtcaggctggtctcgacctcccgacctcaggtgatctgcccacctcagcctcccaaagtgctgggattacaggtgtgagccaccgtgcccagcttttttttttgtttttgagacagagtatcactgtcacccaggctggagtgcagtggtgtgatctcggctcactgcaacctccacttcccaggttcaagtggttctcatgcctcagcctctggaataattggtattacaggcgtgcaccaccacgcctgactgatttttgtattttagtagagatggggtttcaccatgttggccaggctggtttcgaactcctaacctcaggtgatccacccacctcggcctctgaaagtggattacaggattacaggtgtgagccactgcacctggccaaggggacaatttcaactatctttaacatagttggtgacgaagaaaacagaatgcctcttagtggccagaatatatgtcatgacgtacatgcaataaagtccacacacattagtcacagaggagactgactcaaaggccacttaaacacagtgcaaagcagcagcaccagaactcacacaccctggatgggggccgtgtaagaagtaccttgattgatggccagtatctctgaatgatagtttttcccattctggtttctgaccatgtattcctggattggcaagcgtgcggtcttgacagagtattcccgggccttttgaaatgtcaccttctgtaaatatatagttaaatatttttcttataaaaattatacatgagtatattctcaatgtaatacagcattaaaaataagtagcctattgtggaatggaagaaactgcagataatgagttaactgtctcaagagcttatgtgacaatatcttactttttggggggtcactcatccacagtcctccactcactgccacttagaaccaagagggaaataagcaaaagaggcacatctgcagccacagtaggcatcaaaaggcccaagcagtctaatcaatcagagcacattctgagccctaactcagtaagacccaattctggatatctggaacttccagctcattgccaaaaggcagcatcaaattagaggaaaaggtagacaagattcaagacaggtgcaccactgcaacaagtggcattagggtgtgagaagagagagcccaattaaaagaaaggggccaggtgaagtgcctcacacaacactttgaggccaaggccagaggactgcttgagcccaggagttcaagaccagcctgagcaacatagggagatcctgtctctacaaataacaaaaaaaaaattaacagggtgtgctggtgtgtgcctgtagtcccagctactctggaggctgaagttggatgatcacttgagcctgggacatatatcaaggctgcaatgagctgtgactgcaccactgcactccagcctgggtgacagaggagaccctgtctcaaaaatataaaagggcgggctctgaaaactgcaaaaaggagtcacaagaagtccatcaacttgaggccatttagtgtcagagtacagaaactgatgtccctttataagatgttccttagtcatgaagtccctcagactgagtcatgactcagtcagattacatttgctgccttgtaagaagcacaggaaagattttctacctaagacttcaggattaaagagaaaggttcagattactgggataattaacatgccaaggcttggaaggggtctcaatagtgttaactgtatcactctaaccacccattcattgtctgttctctatgacttctccaagaggccatgtggccactcaatggacagctcttgtgacagggagttcatgcatcctgggacaacccactccagttttgatagtaccagctgataggaaattcttcttgatcttgagcaaaattctgttttctttgagacttccactcattcatcctaggtctattcccccaaggccaaaccatgcaagtaagatggcccttccaaaagatggccattcagaaacttgaaggcagtgatcatgcccctaggaatcctctagtctccagattgtagcctcagttctgtcaactcttctttgaatttcaagtcccttcatcattcaggacaagttgaacttgttctaagctagtccagtatcattttgtttacggtcccataactgactggccatcatgagtatggtctaaccaggtggaatagtgtgaagtggacctagtaccttttcggtgctgacacctgcctcacatgaaacaaaattttagatagaacttccaaaaatgttttaagcgatacagggacttatttgaaaggataaaactcctttgcatatatgagctatatgatacgtttgttttataaaaagtcttattcctttataatcactttgaagtacagaattcaaaattaggatatttgggtgttgccctagaagagcttacaatttagtttatgttctttgcacaatgattcataataaaatgactctccttgaagaaatgttgttcttagcttatttctgtgaagaagccaaactccaataacaaccaaaaagttctaaacatctcacaaatcttccagttatttttcagtttaaatgttggtggacagataatatgttaaaactgcacatctgtaagtcatgcactgctcactgaccctctgaacttaactgcctcaaaaaagggactgttggccaggcaccgtggctcatgcctgcaatctcagcactttgggagggtgaggcaggtgggtaacttcagcccagcagttcgacaccagcatgggccatacggtgaaaccccaactcaacaaaaaattagctgggcatggtagcgcccacctgtggtcccagctacttgggaagctgaggtagggggatcaattgagcctggagtaagctgattgtgccactgccctccagcctgggcagcagagcaaggccctgtcttggacggggtgggggcgctgtcaccctgctgcaggtaagactaataaacttttaattattattattgttgttttttttttttttttttagagacagggtctcactgtgttgcatcacccaggctgaagtgcagtggtgtgaccacagttctctgcagcctctaactcttgggttcaagtagtcctccagccctccagactttgtgtgtgtatgaaacagagtctcgctctgtcaccaggctggactacagtggtgtgatttcggctcactgcaacctccgcctccctggttcaagagattctcctgcctcagcctcccgagtagctgggactacaggcacatgccaccacactcagctaatttttatgtttttagtagagacagggttttcacatgttggccaggatggtatcgatctcttgaccttgtgatttgcctgacttggcctcccaaagggctgggattataggcgtgagccaccacgcccgaccctaactttttactttgaagtatttcaaacctaagaaaagttcaaaataatacaatcaatattcattcctgtaatctagactcaccagttgttaatatgttgctttttctctctgtatataaatacatattttgggctggacagggtggttcatgcctgtaatcccagtgttttgggaggctgaggcagaaggattgcttgaggcctggagttcaagaccagcctgagcaacatcaagagacttcgtctctaacaaaaatacagaaaaaaaaaaaaaaaattagctggccatggtagcatgtgcctatagtcctacgtactcaggaggctgaggcgcaaggattgcttgagaccagaagttcaaggttgcagcgagctatgatcgcaccacctcactcagcctggatgacagaacaagaccttgtctcaataaaaaataatttgccaaaccatttcaaagtaagctacagacatcacaatacttcttcactaaatacttaagcatgcatctaagaacaatgacattctaccttaccacaataccattttcacttcaaagaaaacttttaaatctgtaatttcacttaatacacaatctacattaaaatttcctaaactttccccaaactgttttttataaagctttcctctcaatacagaattcaaacaaggctcacatactgcatttggctattacggttttttaaccttttcttcttttccaaattgttttgtagagataggttctcaatgtgttgcccaggctggtctcaaactcctggcctcaagtgatcctcctgccttgggcctccctaagtgctgggattacagacatgagccactgtgcctggacgaacctcttttaatctgtaacagcctcctgcctcggttaagtccagtccagttgttttgcagaatgtcccacattctgatttgtctgtttcctcacaattaaattcagcttaaacattttctgggccagatgaggactcatgcctataatcccagcactctgggatgctgaggtaggaggattgcttgagtccaagaattcaaggctggacacagtgagaccctgtctctacaaaaaattttaaacacgaggctgggcacggtggctcacacccgtaatcccagcaatttgggaggctgaggcaggaggattgctcgagtccagaagtttgagactagtctgggcaacaaagtgagaccctgtctctaaaaaaaaaatttaagaactaggccaggcacagtgactcaatgcctgtaatcccagcactttgggaggctgaggtgagtagattgcttgagtccaggagttcaagaccagcctggaaaacatggtgagaacctgtctctacaaaaaaatataaaaattagctgtgcatggtggcacacacttgtagtctcagctacccaggaggctgaggcgggcggttcaaatgagcccatgagattgcggctgcagtgagccatgatcgcaccactgcactccagcctgggcaacagagtgagaccatgtctcaaaaaaattaaattaaaaactagctaggtgtggtggcatgggcctgtagtcctagctactcagaaggctgaggtggtgggaggattgcttgagcccaggagatcgaggttgcagcaacagagcaaggccctgcttcaaaagaaaaaaaaaaaacattttctgtcaagaatactacacctcaggaggcagagattgtacctgtatgggtgatactaagtttgatcaagtttggataagatggtgaccaccagaatgctttactgtaatgttaaatctttgcctttgttatctgtagggtgatactttgagaccatgtaaatagccggttcctccacaacctttctttcaactgagtcaacaattgtattaggagtgacaaaatgatgattttctaattctattatgcattccttattagctgcattcttctgtaagtagcccctgctcgtattttagatgatcactatggagtcatggaacactaatattttttaaataaattcaattaaattaacctatcatctgtgttaaatatacatacatctcatacatacaggaacatagatagaacacatctacctctacctatatgtaaaatatacccacaaacacatactttgtgatcatataatgtctcaaagaaggatacacaagaaaacttgacatcggttgcctcaggggaggggaattgggagacaaaggtaggaaagactttcattctactcttttatatttatatgttagtctttaacttttattaaacttattatctatgtaatatgttagtaaatataaacaattatcttaaacagctatataacaaacatttcaaaattccagtgacaccccaattattcctctaaaactccaacaaaaaaaatctggataatcctaggagtttgaggttttgggctaagactatttcagcagagagatcaaccttagaaggagcaaactactccctcaaagaacagctagtaagaatgttgagttgatgcttacttggtcaatatcagagttatccttgcagaactgaagagagaaactcaacaatggctatgtaattaccaaacagtgcccagtccagttcccgactcttgatttcgctgacattgctcatgaggagagagggaacttcaccagccagagggccaacctggtggggatggctctttcttcctgttccctctgagttcttagaccctctagaggagactataacagggcacatgcctctaaaagtaagcactgctttttaaaacagatgttggggctgaaatgtatacttaccttctgaatgctttcatccacaagcccaccgaggatgtaaactttgtttagatcaacatcttcaagagctaatgaaaaaatgaaggccaatgagatcaaatctgttttataatttctaaatccagagaaagcaaaatgaaagaattattaacaataaaagtagaaattcagtagaaaacaaaaagaaacttgctcaataaaaccaaaagctaattttctaaaatggccaataaaacagacaaactgttggcatagctaatcacgaaaaagggtagcagacccaaatcaacattagattcagaaaggaaacaaaactgcagaagaatgtgaaataattagatgagaatactatgatcaactgaataccaatacattttaaaattatgtgaaatgaatgattttctaggaaaaaatagatctaacattgatccaagaagggctagtggggtagcagaccaaggacactgggaaagactggcaggcactacacaaggcccagataaggatggaaaccctaagtctgcagctgtgagccatggtaagacacatcgaagcatccagtgaggcccctgcctgtaagaggagcactgctcatgtgcattactttttgtgggggtggggaggggtgtccttcttgaggggctttaataaattctgccacagggaataatgaaacacaggaacaatgggctatacgaatccatgcattcaactacataccgtgttctgagtcaggagtcaggtacacaagggtttccaagggaaataaactaaagcagtcttcttctgttatgtctaactggaaaatgcaaacagtctgatgttaaaacagctcacggctgggtggggtggctcacgtctgtaatcccagaactttgggaggctaaggtggaaggatcacttgagctccaaagttcgagaccagactgggcaacatggtgaaacccagtctctactaaaaatacaaaaaaattagccaggcatggtggcatgtgcctgtagtcccagctataatacttaggagtgaggtggcaggatggcttgagcccaggaggcagaggttgcagagagccaagatcatgccactgcacttcagcctgtctttaaaaaaaaaaaaaaaaccccgctcaaaattcaacgactagttactgggcttcaagtttctatcaggcatggctctaggtttatcaaggaactgcacatgtgacagcttgacagcttctcagaaagtacctagttaggagggaaagtagacacagacgttcaaacctatgaaatgagacagcgatatggggttctgacagaggtacggggagcatgctccaggactacagatgagggagtaacattgggatgacctggggaaggaaatgctggaactgggtttctgaaaggagatttttttttttttttttttttttttttttttttaaagacagggtctggctctgtcacccaggctggagtgccgtggcataatctaagctcacggcaacctctgcctctcaagctcaagtgatcctcctgcctcagcctcctgagtagctgggactacaggcgcgcaccactgcaccgagctaatgttcgtatttttagtagggacggggtttcaccatattgccaaggctagtctcgagctcctgagctcaaacaatccacctgcctcggcctcccaaagtgcaaggattacaggaataagccaccgtgcccagcctcaaaatagattaatattgacatacacaaaaggagaagaactcaaagctgagggactaagaaaggcacgaagacaggaaagtaagggaactatgtggacctgtaaaaaggactgtttggcttatgtaaaagaatcattaaaacaactacatagaagaaaactggaactagctgcactacaagagagactgtgaagacagtaacagcaaaacagctggctgtgcagccccgcgcaatgcacccttcacattcatcacttccatggaccttcctggggaaggtcacaactgctcagtctcagctacacaatgcaaacacactgggcattttcagtgacatttgagaaactcatttggattcttgcatgtatatgtatcactaaatgtatgagatcctagagagaggtgaaaagtaccttagtactccctaaaacttatcttaaatttgcattacttcataaagggattccttctcttcccccaaaactcatgtttcccaattcaccattaatgagaacaagaaaggagtcatggcatttcccaaaaatattcctggagtatacagtctagcataaatatacgggatacaaaatacagtcctagacactggtaacagtactttgccaatgcagtaggaggatgagaaaaaattttaaatttaagaacttatgagaggttctgaatttttttagacttcaatactgaaaatgtaacatatatgaaaaagtaaaaaaaaaatactattaaccacaataacttttcagatgacaattcaaataatatgcaaaaagagacttaccaggtaactagaaaatccatcattcatcctcacacactcttcataaaggggactgtctgttgtgaatccagtgaggcagatccaaaatggcctgtcagcttttttgtttgaaccatacaaccttcgaatctgtccagccagtctacttaattccttcaaagaaataagaacaactcagggcaaaaacatgccaactcactctaaattagctatcaagaaatggctacaataagttcactgaacgctactccagaaaaccccatgtactaggagtacatgtgtgcgtgtattataccttatggcatcacaccttacagacaaaagataatgatacaagtccagaaacagtgaggtagtggaaaacggaattcgccctcctgctggccctgctgttaaatgtttaatatatgaaattcttattttagcttttatctaaaatcttatgtaatactatttaagttattaaagaggtttcattaatatacataaatgtttttacagaacatcatataaatttggtaccttcttcctaacttcaggagatgcaatagggttggaagttttaactttttaccctgaatcacagacaatgctcttatataaaagcaatttcacaatttggcttgatttgttgggtaggagaaaaagactctgggtttgatttaatctgctatcttaatttaacaatatggattttttttttttttttttttttggagacagggtctggctgtgttacccaggctggagtgcagtggtacaatcatagctcactacagcctcaaattcctgggctcaagtgatcctcctacctcagcctcctgagtagctgggactacaggtacaggccaccatacctggctaatttttaattttttagaggcagggtcttcctatattgcctaggctagtcttgaactcctggcctcaagtgatcctcttgcctcggcctcccaagatgctgggattatatgcaggagccactgtgcccagcctaatagtagggaattcttggttaacattttcagaggactagagttagaagtttcaggtaggaacctcagatctgcagttttcctaacttatctgaaaaatatgcaaacactagcacataaaacagatgtctaaaaagagagtttacaatttacatactgtgatgtaaggcctaaaattaaggcccagtattatgcactgccttgacatctgtcaaaactgggaatacttcaaatagcctaatagtaagctcccctcccaactctgctcccgtagataaggtctcctagctttaaaaatcctttttatacaaaatcaatgtgcaaaaatcacaagcattcttatacaccaataacagacaaacagccaaatcatgagtgaactctgattcacagttgcttcaaagagaataaaatacctaggaacccagcttacaagggatgtgaaggacctcttcaaggagagctacaaaccactgctcaatgaaataaaagaggatacaaacaaatggaagaacattccatgctcatgggtaggaaaatcaatatcattaaaatggccatactgcccaaggtaatttatagattcaatgccatccccatcaggctaccaatgactttcttcacagacttggaaaaaactactttaaagttcatatggaaccaaagaagagcctgcattgccaagtcaatcctaagccaaaagaacaaagctggaggcatcatgctacctgacttcaaactatactacaaggctacagtaaccaaaacagcatggtactggtaccaaaacagatatagaccaatggaacagaacagagccctcagaaataatgccacatatatctacaactatctaatctttgacaaacctgagaaaaacaagcaatggggaaaggataccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaacggcaacaaaagccaaaattgacaaatgggatctaattcaactaaagagcttctgcacagcaaaagaaaccaccatcagagtgaacaggcaacctacagaatgggaggaaatttttgcaatctactcatctgacaaagggctaatatccagaatctacaatgaactcaaatttacaaaaaaaaaaaaacccatcaaaaagtgggcaaaggatatgaacagacacttctcaaaagacgacatttatgcagccaaaaaacacatgaaaaaatgctcatcatcactagccatcagagaaatgcaaatcaaaaccacaatgagataccacctcacaccagttagaatggcaatcattaaaaagtcaggaaacaacaggtgctggagaggatgtggagaaataggaacacttttacactgttggtgggactggaaactagttcaaccattgtggaagtcggtgtggcgattcctcagggatctagaaccagaaataccatttgacccagccatcccattactgggtatatacccaaaggattataaatcatgcttctataaagacacatgcacacgtatgtttattccggcactattcacaatagcaaagacatggaaccaaccaacgatagattggattaagaaaatgtggcacatatataccatggaatagtatgcagccataaaaaatgatgagttcatgtcctttgtagggacatggatgaagctggaaactatcattctcagcaaactatcacaaggacaaaaaaccaaacaccgtatgttctcactcataggtgggaattgaacaatgagaacacatggacacgggaaggggaacatcacacaccagggactgttgtggggtcgggggacggggggaaggacagcattaggagatatacctaatgctaaatgacgagttaatgggtgcagcaccaacatggcacacgtatacctatgtaacaaacctgcacgttgtgcacatgtaccttaaaacttaataataaataattaaatacttttcatcaagggtccaaggcataatctctttatccctaaggagttttggttccctgccagcccatggaattttcctaacaagccaatcacatcctcctatagtaaccagggggcacctcaacccctggatactacaaagcccacctcacacagccccttgctgttcattctgttcttgattacaatccccacgtggccctgtatggtatacagtatcttcctcccctgggctgtaagtatatgagactcatgaactgctgtgaatctcatctgtccagtgtcaggtgtcatgcattctgccattcccagaactctagtgtgggaatccctctttcatcaatgaggtgaatgagcatcaattaaaacacatacattgaggccaggcacagtagctcacgcctgtaatcgcagcactttgggaggctgaggcaggtggatcacctgaggacaggagtttgagaccagcctggccaacatcgcaaaatcccgtctctactaaaaatagaaaaaaaattagctgggtgtgccaggcgcagtagctcacaaggtcaggagatcgagaccaccctggctaacatggtgaaaccccatctctactaaaaatacaaaaccttagctgggcatggtggcaggagcctgtagtcccagctacgtgggaggctgaggcacaagaatggcgtcaacccaggaggtggagcttgcagtgagccaagattgcaccactgcactccagccccggcaacagagtgagactctgtctccaaaaaaaaaaaaaaaaaaaaaaatttgtcaggcgtggtggcagacgcctgtaatcccagctgctcagaaggctgaggcagaagaattgcttgaacccaggaagcagaggttgcagtgagctgagattttgccattgtactccagcctaggtgacaaaagcaagactccatctcaaaaaaacaacaacaaaaaacacacacattgcaaaaagttcttccaccaggtaatcttcccacaacatgctaccaggcaaatattcctcttcccaaaggtttagtgtctggaaaactgaacctgaaaggttccatccagactgaggatatcatgaacagagaggcaaagatgttgggcttaaaacagaagacaaggtaaaaatttgcaaactaaaccaaactatatatattctcttccaggttcgttacaacagccaccttggaacttagtaacccagtatagaaaatcaaacactttactagtttactaaggaatcccagaagctggagttgaccatattcttcggaaagctgtacccttctgggcctccctcatggcgagcaggaattccaggcttagtggatgttctaccttctttgacatgtagtgggtcatactcaaatcgatacatagtcttggtcctgagtgtttggcttccaaaagtttgtctttggttagagctctcaggaaacgtttgctgtgctgggggcaaatgcctaaagcagaaatatcagaaagaaataaaagtggaaaaccagaggaatattatataagaaacaaatcttagccaggtgggtattttgcatataaagagaaacttgatactgatgtaaggtattcgttcattagaagatttacacagagtggtgaggagtatgggctctgcagcacacagcagggtttaaatccaagttcagtttgttcattgattggctacattatcttgggcataattatgttacttaatttctctaagcctcagtctcttcacctacaaaatgggaatgataataacagctcctctttattgaggtaatccatgtaaaattcttagaactgaacctaacacagaatactgaataaatattagctgttgctggtatcactcctattctgagcttataaacacgttagttagatagcttatatttgaaaagcagccttaaatttttttttttgttttttttttttttttttttttgagacagagtctcactctgtcacccaggctctggagtgcagtggctcaatctcggctcactgcaacctctaatctcccaggtttgtgattctcctgcctcagcctcccaaatatagctgggactacaggtgcgtgccaccacacccggctttttttttttttttttgtatttttagtagagatggggtttcaccgtgttatccaggacggtctcgatctcctgacctcgcaaatccacccacctcagcctcccaaagtgctgggattacaggtgtgagccaccacacccagctacaaattttgctttctttgatgttttgattcccaagaaaatagggcagtgggtcccacatcccagatgctttttacttatacaaaattcctactctcattggaacatgcagacacgtttgctaaaaaataaatattattataccaacagtctcatttattgtcacctggattttctgcacgattggcttttcttcgttctttttcttgctttcttttgctcttctttgctgcaactatcttttcccagtgtctctgttttctctggacatttttcttatattatccagaaaacaaaattgtttgagaacttcataagcaccaaaaaaggaaaatgaacattagaaacatttgcttttttcttatttatatatatagtttggagagaaagaggaaattactcttaaaaacaaacctagactggatcgtgtttagagaaaacagagccccagaaaaagagacatgacctggtcaaggtcacagaaaattcattagtgacagggcctggagtttagatttcctgacccttcaggggtatatcaaaaattccttttgaacttttcctatgactcaaatggaactaaaactttaaaccagttagcagaaaattcatcactcagaatacacaaaactcattccgtctctcttttcactaccagtatccatctttaaaacaggggtgtcttgagacattccatcattcaaggcctatggccaggcaattcacgcactcaccgagcaccatgccgtactgcctgtggccaggatctctccctcctggcactcgccttccgcatcgatctgcagaagctggaagccttcaggaagtccatcttcacctgtctcctctaggatgccttcttgcccctgcagcacaggtgactctactttctgagtactcccttccaatttccagtccatggacttagtcctctgtcctttccaccagactggaaaaaggcacaattatgtgagctattacattatttcactaacataggtatctccctacatccaaatgacaaagtgttattgtgttactgaaagaagtgtgtaaaatactgaaccagatttactggactgagaaaagcatgtgtcttccagatacatgattcagcagagaaacagttcagtagtaaggaagttttgtttgtttgagacggttttgctctcgttactcaggctggagtacaatggtgtgatcttggctcactgcaacctctgcctcctgaattccagtgattcttctgcctcagcctcctgagtagctgggattacaggcatctgccaccaagcccggctaatttttctatttttagtagagatgggtttcaccatgttggccaggctggtctcggactcctgacctcaagtgatctacccatctcggccccccaaagtgcggggattacaggcatgagccactgcacccagccccagatacacttcttagaggacatgcacaacacctgacgtctccaagcaatcaatgattatccatagctgcagtgacacagataaccaagttatttattgtgtactttaaaatgcatgatatgatttgagggtaagacagattgcaaaagccacttcacctcccccattatgtttcaaccagtttattttcaaaattgttcctttagcaaatatttattgaatacctactgtaagtaaggtactgtactagagacatcttgggagaatgtaccaatgtatatagtagagtgacatgaaaccaagaattcttttaggttgttggtatgtatcagtttttttaaactatgtatttcctccaactcagttgaataccactgcagtagaaagccagtcaccactgaaaatgtttaatatccctcagaagtgctgaggttgaatactacagacaagcactcttacacaacacttaatgatgtcaatttcaaagtggagttcaaaatctgaacgatatgagtcagaaatgctttagtcaatggtcaaatgtcacagaacacaaatgatgtgaccattacctatggctggtcctccgggtgtagtcacacaaccacttttatgaaaaatatatcttaaaaagtgttaagtctatgtagtatgattcatgtatatggtgttaaaaaaaaactacaatgaaaagtaacaatccacactcctatcccttccacctctagtggcaacccttgttaaccagttcttttttgttcttttggtaattaactccttaaactgaaatcatatgcttacatcattatttcatgattcatcagctttgaatgtattgactccctatgaaacataagaattcaaatcgcttaaatcagtccgtattattactatttttgagacagggtctcactgttacccaagctcgagtgcggtggcacaatcatggtttactacagcctcaacctgctcaagcaatcctcccgcctcagcctcccatgtagctaggactacaggcatgcatcaccatgcttggctaattttaaaattttctgtagagataggggtcaacccctatttaaattacttattttgagatggagtctcacactgtcacccaggctggagtgcagcgttgcaatctcagctcactgcaacctctgcctcccaggttcaaacaattctcctgcttcagcctccccagtagtgggattacaggcgccagccaccaggcctagctaattttatttttagtagagacggggtttcaccatgttagccaggctggtcttgaattcctgacctcaggtgatccgcccacctcggcgtcccaaagtgctgggattacatgtgtgaaccaccgcacctggcctattatttttaattcttcattagttatcttgattttgaaatttgagatcaagttaccttgatctttacatttttttggcaaagattttaagggtacagtttaatgaatttgtgtatgtggtaaaatatactaactcaatgagctttaacaaatgtataggttctgtgttactgacaatcctgtcaagatatggaacgtttccatcaccgcagaaagtttttgtttttgagatgaagtctcactctgttgcctaggctggaatgcagtggcataatcttggctcactggaacctccgcctcctgagttcaagcaattctcccatctcagcctcttaagtttctgggactacaggcacgcaccaccatgcccagctaatttttgtatttttagcagaaatgaatttcaccatgttgaccaggctggtctcgaactcctgacctcaagtgattcacctgccttggcctcccaaagtgctgggattacaggcgtgagccaccacacccagcctcactccccagaaagtttaactttcttctccactttccaaatcagtcttcatcccattcccacaacttgccaaaggcaaccactgttctctttgctataaccatggattagctgtatctattatacaacttcatataaatagatgcaaacagtatgtactctttagcacttgacttttttcccctcaaaatatttgagacttatacatgttgctgcatgtatcagtagttgcttttttattgctgagtagcattccattgtatgaatatatcacaatttattctgttgatgggcatttgagatcttttccagcttggggaataaatctgctatgaacattttcatagatgtgtttttatggatacatgttttcacatccattgactaagttttaaggtagaattgctaggtcatagcataggtgtgtatttaactcataaactgccatccatttcccaaagtattataccattttacactgcctgtcagcaatgtatgagcattccaaatgttccacagcaccaccatctggggacccgtacacagatttctggggctcctttgctacaccactccctccctgctgtatccaatctcagcagccctaaattcaactgtttgctccacccagtgacacagacgtactctgtatgggctccgtgtcactatgcaccctcaggtagaaagccagggtgactgtggggcttagcttgtgtgtttcttttccctcaaggattacagtcttgtcctgactactgcccaatacctgaaaacaatttcttcatatcctttctccagttttatagtttattgtaggaaggtaagtccaatacccattccttctgtcatgacaattaccaggagtctattacttttaagaatattttaaaacttctacttcttgttcaagttatagtatttctgactccccaatctttaggctgtgaacataaacacccttatatttctatctctgttctccctttaattttccaactgagcctttaattttatatggtcaaggtaggttttacattttgccctgacaaaacaattaagtgctttgtctatccccgtggtattttctaaaatttgtaaaccaaatttgtaaactattattttttcagacagggtctcactctgttgcccaggctggggtgcagtggtgcaatcacagctcactgcagccttgacctcccatgctcgggtgattctcccaccccagcctcatgagtagctgggactacaggtgcacaccaccatgcccagctaatttttgtatttttagtagaggtagggtttcaccatgttatccaagctggtctggaattcctggactcaagcaatccgcctgcctcagcctcccaaagtggtgggattacaagtgtgagccactgcaccagctgtaaactgcatttatattataactccataaatattattcactgtagagatggctagtgtcctagaattatgttttcttttccattttgactcctgtgtttggaaaacatttctagtgttgagttcatattgcttttcttgtactccatcaaatgctcaaaattgggccaaactttagttgttttcagtttagacacacttaaaataggtttaagcgggaaaatagcattcttagaattcagacacacttcccagcttgccacttgtgagtaatgggacaatagctagaggatttaagtctctgccatagagtctctccacgaaatgggataaaacgacctcacaggattgttgcaagaattagatacctttcacttactgatataaaacaagtactcatgaaatacttgctgttaactactattcaaaaccccttcagtgttgttcttacagttgctattagaaggtaaatcttctgagcagttttggttattcatgacttatcatgtgaacatgtgaccaccagatatattcctgaagatgaccaagtaaattaccttctagattttcaaaattatagatttgaaatttgtgtccatttgtctgcctaggctaaagtttatttctgcttagaaatcctttaaaatccagtacacatttttaaatgtatttacatacagactatcacaaagaattagtggcatgcataaaatttcataatgtgtatctccagagaaatgaggaaaataccaagctggctgggcgcagaagctcatgcctgtaatcgcagcactttgggaggctgaggagggaggatcaattgagcctgggggttcaagaccagcctggggaacaaagtgagaccccacctccacaaagaattagatgagcatgatgatgcacacctgtagtcccagctacttgggcagctgaagccagaagatcgcttgaacccaggagatcaaggctccagtgggctatgattgtgccattgcacttcaacctgggtgacacagcaaaccctgtttcaaaaacaaaacaaaaaatccaagctattcttaaacatttcagaagcactccacatgaatgaacagtgaagttgatcacaaattaaaaaaaaaaaaagttaagagataggtcttgctatgttgcccaggccagtatcgaactcctggcctcaggccatcctcccacctcagcttcccagtcactgggtagagatgtgagccacctcacacctgtatatgtatatatgtgtgtatgtatatgtgtgtgtgtatatatacacacatacatacacacgcatacacacatatgcacacatatatacacatacacatgtatgtatacacatatgtatatatgtgtatatatatatgtgtgtgtgtgtatatatatatatatatctttttgagatgagagtcttgctctgtcacccaggctggagcgcagtggcatgatctcattgcaatctcatgactcattgcaacctctgccacccaggttcaagcgattctcatgcctcagcctcccgagtagctgggtctacgggcacgcaccaccacaccacgctaattttttcattttaagtagagatcaggtttcaccaagttggccaggctggtctcaaactcctgacccaagtgatccacccatctcaggctcccaaagtgctgggattacaggagtgagccaccgcacccagccatttttttttttttaaacaaaagatatctagacccccattatgacagttcttttagatgaatgaacagacttttataccatcagagtcatctgcattttcctgcatataggcattcagaaaataacaaatgaaaacattaagataaactaatctttaactgacaacttcattgtattagggtgagaaaaccaacacccatttgttaaataaatgctagttaatagccatgtgatctcttcctcctttaaacttcatagcattttgtatttttacctgtgttgaccattcattagttaataaacattccaccaagctcctactgtatgccggggcctgttggggaatgactgggaggcaatggatctagagatttctctggaggtagtctggctaaggaggggaaaagagatctaggataggagatcctaggagctacagacttccactgttgttttcaaaaattggaaagtctgtgctggtatcttctctcctatcaaactgaattc

SEQ ID NO: 26 - DNA, 2902 bp, Homo sapiens
agcgggacgcgcagcaggccccgcccacccaggcggtaggaacccactccggcccgctagacctgctgctatgtcccggccgcagcttcgacgctggcgtctcgtctctagcccgccgagcggcgtcccgggtctagcgctgctggcgctgctggcgctgcggctcgcggccgggaccgactgcccatgcccggagcctgagctttgccgcccgattcgccaccatccagatttcgaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggtaacctttgatgtagcttggtctccaaagaacatagacagaagatgctataattatactggaattgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaaacaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaacctacaatgtagtgtctcccctttaggttcatcaaactgatgaaaataatttttctgcttcctgactccatatagtatttatgttctctgaggtacttgaactaaatctttggacagtgagtgagaattaaaaagaatccagaagattaaatgtattcacaaaatagaagaatgtaacagtaatattttgaattggtaagttaaaactacctaatattttccaactacattatttttatgaggctcatttgtaaaatttttaataataggaataacttgcagttgaacttgattctgttcactgtcacacttctaattattcatttcttcatttatggacatatataatttatttcttggctagcttgcttacatggttaaatttttctttctacatctgcaatgtatcttttttatttttattttttgtagagacagggtctcgctatgttgtccagatgggtctccaactcctgggctcaagcactcctcctgccttggcttcctaaagagctgggattacaggcatgagctgcattgtgcttttaatgatctaaagacactgattagcttctcaactagttctctttctaaaagatcaattttatacaaataagttttctaaatgtaataaagtctgttttctttctccagggaattaagaacaacattgtgctgcccttattagttcctaattacagattaaaaatctgtatctttgaactctagatttacataaatcctggcttccctgcacattttgcccctgtaaattggaatacatgatgattgaaccatctgttatgagaatattacatttcctatttacacaattgtttgtgacagagtaaaaaccattttcatagtatatgttggatcactgttgtcttcatatttctaaaataaatgaattaaaaaatttaaattcttagatgcttatctctatcatagctcagaatgcaacttcaatacccccattcttttatatttccagatttcttttaattaagatataatgaacaaattaagttaaatgaagtctgtattttcatgcaaatatattagtattcattaatatacatttattctttgcaaatagattttagttatattagctcttaaattgttaaataaattattattgaattttattattaaattattaaaatgaaaattataaaattagcactgtaaaataatatgtaaaggacttggaatgttaaaaataaccattcatcattttgctttatattacatctaatatttcctgaaacattttgtaatacccacatggaaagtggagaaagagaaaccttgtgctttttataaaacattgccaaggagaataatggttaaacaaatctgttcaaatacatatttaaatttttttacaaataaaagttttaaattaacatacccaaaaaaaaaaaaaaaa

SEQ ID NO: 27 - DNA, 3221 bp, Homo sapiens
gttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcgtcagtgaagtttaacaagggctatactgctcttagccagagtccagatgaaaacctggtgtccctcgactctgacagtgatggggagctgggatccagatactcctccgggtattcatctgcagaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcctgtgcccaggctgtgctagatagtgttgaatggaggcagaaaatagcactttatggtttattatagctggcaatccaaaaaagaaactgtttgagaccagttcgagaaattccgtttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatctctgctgtgacaccccctacccacaaattggagagtatatcttgctatactctataccaagcctctttctagaatttttccaacaggttttgttttgttttttggcttaactcagaaccatggtgagcgttctgctttgttttgttggaggcagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacactaaaaac

SEQ ID NO: 28 - DNA, 194520 bp, Homo sapiens
gaattcctgacctcatgtgatcctctctccttggcctccaaaagtgctgggattacaggcatgagccactgcacctagccttaattttattttatgtaatttttctgtacagatggggtctcactatgttgcccaggctggtctcaaactcctgccctcaagccatcctccccacctcggcctcccaaagtgctgggataacaggtatgagtcagggtggcttggcctatgaagagtgttttatatgcacctgctgatggcagcaaaagtttactggaagtttaaaggcagttgtagcaatccaagaactcgttcattcattccttcattcaactgtcaatgttagaacctgtttgtgacggaaattgaggacacaacagcaaattcaaaaaattgggtttctgttctcacagaatttacaatttggtggtgaaggtagaggggtaataagcagttggagtgtgggaagtttctgtgataggagaagtaaaagttcagatttgaggtttcggagcatgacaaggggagcgttgtttaatggaggagaatgggaaaggagagaaaagagcaaaccctagaggcaccagaaaaaaagaaatggcaggggctagattggatacagaagataaaggggagaagagaatcccagttggtccccaagactcaaaacacacctgtaatcccaacactttgggaggctgagatgggtggactgcttgaggccagaagtttgagaccagccttggcaatctactgagatcccatctctacaaaaaaaatccacaaaacgccactgcgtaattgcagcttttgagcccacgtttgtgtgacaccaatgttctgtgccctgaactcgtaagccaaggtaattctgactgtgtattgtgaacaagagaattcatctctctgacctatcaaaagtttcaggcagttaaaagttgacctttgggtgcgtgcaggggttcacatctgtaatcccagcactctgagaggccgaggagggtgcaatacttgagcccaggagtttgagatcggcctgggcaacatggcaagaccttgtctctacagaatttttttttttaattagctgggtgcgatggcacacacctgtggtcccagctacttgggaggccgaggtaggggaattgctggagccactatactccagcctaggcagcagagcaagacccggactcaaaaaaaaaaaaaaaaatgctgagcattgaataaggtgtttaaccttcttttgctttgttaacaagaaggctgaagaagtcaaaaaggggaatttcttatcctgacctatttctggacaacaaggaggaaatcactggtgaagtggaaacaatagaaagattgggggaaagccagattacaaccctagggaggagaagaggaaacagagctccatgccagtgcccgacctcaggaaggcagtgtggaagaggctggcgtggaagtggcccaagagaagaaagacgtgagcttctaagagagaaagtgtaattctctctggacaatggccaaagaccctgaaaaaggagaagagaggaggtaatgaagccagtgtggctcaccagagagcatgtcagagacaccagtcaattcagtggaaaaagaaatgaccagtacaattacttatcatgaggcagaccaaagcaaaatgtttcgtaaacatttttcttcctcagtcttttgtgctgtcttaatagagtgtggtttgccatggtttagaagagatagcacttgaaacatttttcactcttctgaacaaactccaagtatgaaattggtcacataaatagcaggaacacaaaactgaatatccaatggctttaaactgcctttcctcatgcttatgacagttaaccctggaaacaatgacaactgcaatgacaaccgtgtcctgaccccatgggaattccaaggggactaactaattaggctgattgggagatgcaaagcttcctctttcgcctaggggttttctacaaatggccagccggcaggagacggaggtcaggacatttgagtttacagtaaaacaatacctcggtgtctaagaagatgcgttctcattaaaactaagaaaaggggtttcttggctgggaacgatggctcacgcctgcaatcccaacactttgggaggccaaaggaggaggatcacttgaggtaaggagttcgagatcagcctggccaacatggtgaaactccatctctactaaagatacaaaaaattagctgggcacggtggcacacgcctgtaatcccagctattcgggaggctgaggcaggagaatcgcttgaggtggaggatgcagtgagccgagatcgcaccattgcactccagcatgggtgagagggcaagcctccatccgaaataataataataataataataataataataataataataataaataaaaatgtcaaagaaagagaaagaaaaaaaagtaaagttgatgcccatcaacaggagttagttaaaataaaaatttctgaaaagtggaatactatgcagccattacagcaataaggtagatataacaacatacttattaatatagaaagatactcatgatatattttaagtgaaaaatcagattacaaatggtaccttatttcatgtttatacaaagatccatattgtatgtttctatcatggtgcttacatagaaaaagtctgcaatgttatctctggaggtggaattatgtgtttttttaaggcaatttcagaaaaagaaggaataaagggtgttggctttgccttctgtgattgggcaagtaatttagcctcaatttccacatttcataaaatgggattatgagagttaaatgaggtaatacacctataggattttgcacatggtaagagctcaaagaaggatcttttattctcacagaatggcttcttaagatgtggttaataacttacaactgagtggggtcttgggaagacctgcagccaggaatgttgtctcaaactgcagaagtgaatgggaacggcatttaggtaggagctgctggtatttctctagactcaaacttttccctcattttccctcctttctgtctgtgctcaaggctcaactccttcagaaaataggaaaaaaaaaaaaaacaactcctctcccaggctccataatcttctgcaattgtgtgtcactcattgtatgtgacagcctgcttttcagtttgtggttcttctgagcaggaccctggctcaccacccagaacccaaacgaccaccacacagctgtttaccccgtaagcactcggttagtgcctactgtgggcaaaacttagattcacagagttggaaaattaaatatttcaggaaaaaggaaaacatcaggcttaggcaaggctaaggagaaggtttcagaagaggttactaagtaattacaacagtcctattcctttttttttttcccataaaagtggaaaaagctaaggtagatttggaatttgtaattaagtctgtagagataggaaattatacaaactaatgggtgaaatatcctggaaacctttatcaggaccaggacaccaggacggctagaaagttataatttaataaaacataaaggcaagccctagtaaactttggcgtaatatttgaggaagtaaattggagaaatgaagccatgaaagtggggaagccgagagatttctggtgcacataccatgaccacaccaaagttttttcaggggtagtgttattacaggggcctttcagtaacagatttttaaaaaattgtatcactttgcctataaaatcttgatacatgactaaaatactgtacttcacaaaccaaattcggttcaattaaattgttgaatctaggtggtaggtaaagaatgctcatgcactattatttcaacttattagtaaatttgaaactttctataataaaaagtcaaaaggaaagacgggtgcagtggcacacgccaagttgcagctactcaggaggctgaggcgggaggatcacttgagcccaggagttagaatccaacctgggcaatatagcaagaccctgactctaaaaagcaaaaagaagccaggaaaggtggttcacggctgtaatcccagcactttgggagggcaaggcgggcagatcacgaggtcaggagtttgagaccagcctggccaacatggtgaaaccccgtctctactaaaaatacaaaaattagccgagtgtggtggtgcatgcctgtaatcccagctactcgagaggctgaggcaggagaatcacttactcacctccaccgagaggagaatcacttaatcacctccgccaggaggaggaggttgcagtaagccaagattgcgccactgcactctagcctgggtgacagagcgagactccgtctcaaaaaaaaaagcaaaaagaagggccaggcgcggtggttcatacctgtaatcccagcactttggcaggccgaggtgggcgtatcatttgaggtcaggagttcgagaccagcctggccaacatggcaaaaccccgtctctactaaaaatacaaaaaaatagctgggcagggtggcacatgcctgtaatctcagctactagggaggctgaggcaggagaatcacttgaacccaggagacggaggttgcagtgagccaagatcatgccactgcactccagcctgggcgacagagtgagactctgtctcaaaaaaaaaaaaaaaggcaaaaacaaagaaaagtggaaattacccctgactataatctagtcctccatccccatctcaacatagagcctcatgtggagagaaaaagacatttagagcactcagaggcgtgttcaaattttgtgttgttcgtttcttgttcagtactttgagcatgttttctcatgaagaaggagggcccatctttcctttgctgtgtgtcgtcagtggcccataacacctggtacattatcagtaccaacaatgcacatcattagcacaaacactgtagctcttcaagaactttcaaataacaataaacactgagtactgggtgttgtgctaagaaccatgtgcatggtccttgcagtgaagaggatgctgtcgactcatctttggcccagactgcactgtgagttgcattccagatatgatgatgaattcattcatttattaaacacacttactgaacaaggcattgtacaaagatagagaaatatggcagcatacctattcttagagtttataaactccctggtgagatgtgacatacatacttatctgttgccagataagtaggaatgagtgaggtacaaaacgctataggagtcaggagctcacctaattcattcatttggctacctctataggataacaatctggggtcatgggtatggattgtagccatggaatgaaactacatgaagcagcccactacattggcccatgacccatatgtcagtgacatggtccccaactggcgattctgtaaaatctcaaaaggttataccagatatcaccagcacagtagcaatctgtgtacattcttgcgggagagggaaagcaacattaccttattcactcttgcagcccatcacagcatcacacccatcaagaggatattaaagtaatatttgttgaactaaattgaatcgaccccttctctctttgaatcaggttcagaagagattcccataatgctaagagcttatctaacatggggataggatacaaaggagagaggggacagtgatatgctgatttccttctgaacacaggccaagtggtaatcaagtcaactagggtaaagaggggctgactctccaaccttctacatttaaaagcttgatgggccaggcgcggtggctcacgcctgtaatcccagcactttgggaggctgaggcggttggatcacttgaggtcaggagttcgagaacagcctggccaacatgaagaaaccccgtctctattaaaaatacaaaaaattagctgggcatggtggcatgcacctataatcccagctacttaggaggctgaggcaggagaattgcttgaacccaggagcttgcagtgagccaagatcgtgccactgcacttcagtctgggcaacagaataagactctgtctcaaaaaaaaaaaaaaagcttgatatttctgaataacagcttacgatgactgtgggttgatgcctctaaggcaatggttctcaaaaaaaaaaaaaaaaaaaatgccaggggttatttttctcaatttggcagtgtctggagatatttttggtcacactgggaaaagggaatgtgctcctggcatccagtgggaggagacccgggatgctgaaaagtatcctacagtgcacaggacagtccttcacaacaaagaattatccagctcaacatgccagcagcgccactgttgacaaaccctgagtttgggggagtgtgtttcagtcagctcccagaccagtctgcattcttaattactttaaaaatgaatgctctgaacattggggggtttcagtaagagacagtagacaactccatgcaaaccctgcactgagattctaaaagtcccaacaagggacttttagtacaaatcccttttaggtataaagagtaacaataatcatgaaacaaacacttagcggaatcaaggtgaaaagaactcctactcttcatctagaacagggctagccaatgaaacagaatgtgagtcacaacttcaagccttgtacatcatttacaaattctgttggctgtataaagtaaaaggaagcaggtgaaattaagtttaataacatatttcgctgaatgcgatatatccaaaatactatcattttaatatataatcaatgtaaaaattgttttaattttattattattttttctttttgaggcaggttcttgctctgcatccaggctggagtgcggtgacgtgatcatggctactgcagcctcgaccacctgggctcaatcaatcctccaacctcagcctcccaagtagctgggactaaaggtgtacaccaccacactcaactcatttttgtattttctgtagagatgggattttgccatgttatccaggctggtctcaaactcctaggatcaagcgatccacccgccttggcttcataaagtgctgggatgacaggtgtgacccaccgagcccggccaatataaaaattattaataatatattttacattctttttttcatactaagtcttcaaaatctagtgtgtattttacaattagagtacatctcaatttggaccagacacacttcaagctctcaatagccacatgtggctggtggctaccgtaccggacagcacagatctagacctgtgataggaatcaccaaaggttctcattaaaaaagcagagtctgagcgttttgccccagttttgagtcagcatgtctggaatgggagccaggaatccacattttaaacatttgctcagatgattcttacacagttgttcaacagaccacatgctgagaaaggatgatttattctagtccattgacttgtttgaaagataacatgtgcgtctcagtgtctcatagcctagtccaaaaccatgttccatagcattagtttaaagagacaagagatgtcataactatagaagatataggggaaagttgttttttgttttccaaagaaggaatggagaattcctcccacaagagaatctttcggctgggtgcagtggctcacgcctgtaatcccagcactttgggaggcccaggtagggtgaatctcctgagctcaagagtccgagaccagcctgcgcaacatggcaaaaccctgtctctaccaaaaatacaaaaaattagtcaggtgtggtggtgtgcacctgtggtaccagctacttgggaggctgaggtgggaggatcacttgagcctgggaggtggaggttgcagtgagccaatattgcaccactgcactatagcctaggtgacagagtgagacctcatctcaaaaaaaaaaaaaaaaagaaaaagaaaaagaaaagaaaatttgttgttcttaaaaaaaagaatcttgcatagtttctcatacaaatcccgaggaaaacaacattttccttcagcacttactattgggctatttctgcatgtattttttgaaaatttaaatcaatacacctatgagtaatgtttttctgtttttaaggagttttacttcctcaatcatctgcaaatgttttaggggagactcagtgtcctacacaccgcactctcaaacaggaagtaaaaactaccttgtgactcagaaaatgccagagaaccagactcaaactagaccagactaatacggttctttctgttttcatgcagcaggttatattatctaaagtaatggtaagactgctactgtatcctcacatctgcttattgttttcttatctccaatttcaactcaataatagttaaactcataagtgaatttgcttccataagtataaaactgtccttctcaagggcgacaagcaaggagaattatgctaaaaatggtatcttagagtcctttgtggtctcacctgtatccgttatcaagacccttttgctcacaaggaaatgattttcgagagaaggtccacgtacatctgatttgtgggtaggctttaaacctgacagaaaaacaaaactcttcatattggtcaatttcataatcttcacttgaattggtagcatttataaatcccttttctgtaagaaaaaataggcatttatgagttagttaataatattcatagggaaacgtattgagaagataaaataaacttgtattcatcagtttaacacaggaaaactcaagtgttggcatgctgcaggtcaggttggataatccaagtgaaaacccaggagtcctatccctagttctaagcctgagctcatcatctttcgaagttaagaaatgtttaaaaaaagaaagaaggaaagaaaaagaatgggatgtagataattgactgtctggcccctgctctcagccagcaccactcttccattgatgagagagagtaaaataaactcaaggcacaaataaaagagcgatctggctagcaatattcacgaggttgccttatggaacacttccttattaatctgctaagagcatcgctgtatttctcggcattttcattatggctgaacgctgtgccctaatctgagattattgaactgtggttattttcagatcctacataccccaccaaaatttcagtgcatctaagggcttgtactgtctctcagtgctcactgccctaacagtgcggttagttggttcttagaactagtatttattgtccattttgtgtcaggctctgtgtcaggttctggaactacaaggatagaatgagttgttcttgtccttaagaaacttacagtctactggaggataaaagtacacaaacagatggtcatattacaatgtgttatatgcaaagacagtggcattcaagcgagcctggtttaacgggaaaaggaagagggtgggcagattatctttgcaaagctattctaactcagtttctttcttagtgtttgatagtagcattatattgaaatcagaatttgtaccacatacttcacattccacactacagcgactaaaaataggaataaagattgtgtgagcagcctgcattacctacgatggtaaccaaagctgattgactgggatgctttgaagaggaacaagtgtagtatccggtgtcgtttcttgccactgatgatacaaaagcaaacagaatccgtatcatagttctgtttgttgaataggtactcatctcaaagtagttgccctaggttttaataaaacagagtttgcatttaatgttttcaatccagactattagttaattgttcctgcattttcagaatacaaacttgtcctattacctcctcgagtgctttgttttctaattcccaggtgagcccgaatccatggttcacatgaacagctttgcaccttatccataagggttcccctactttaagaaataattgtggcaatgtggtctgaggagtttgatttagatctaggagatgaaaacatcccaagtgagaaaaaaaaagtgatttttgcctcatcacaaaagatatcctgaacattctgaacaaagactttagcatcatctcaaatattactaaccacattaataaaagaagcttttagagactgactcctcttttatgaagaaatcagcatttacagaatccataatattgcatttactgtgacctgaaggaatgataggatttctgaagttgaatgatcacctacgcagttactgttagtccctgatagttgctaagaaccggtcactgaaaatgaaagtgcatgatattatagtgttacctattgtgaacagcctggtgcattccctgcccagttcatttctggcacagcaccttatgtccgtcccaaataattcatgaagcactttttcctcctttttaacaacagctggactttcttctttacagctgcaattagaaaagaagtaccatttggctaaacaagttttaaaattacaaatgaatgctcaagaggagaacaaagttctagagccagttttaagggtcaaatggtaaacaaaaggtcaaaaggtaaacaagcccatatctatggtttcagctaagagctcagaggggagctagctagttactcattatcgcaatgaattagcataacactaaggagaattacataacaaaacagtttaaaattgttcatgtttggtgatctctttgttgctgttgtttaaagacagggaaagaaagggaaaaaaatgagaaagaagataaaggaaaaaaagagaagaaagagagaagagaaaaagcatgattgggctttcatgaagtttagcaaggtaagcatccttttgggacgcagtaagggagggggaagctaaagtttcaaaagtcacccgagttcccataggaacagaggagggccaaggtgtcacccacaagggaagtcagccaagactcccaagtattcaacagagcaaaacccctctccctgcctcagcagaaagcgaacttttgtaccactttggaacaaagtatttggtactttttctccttctatttggtcctattttaaaaaaaaaaaagttgtttagtaaattttaattagttcaaactgcatgaatttttactttgtaagaacttaactttggcatatatgaaaaactatgtaaacatttataccttacttagtattggctaggcactgttctatgtgctttacatatatcaattcatttaatcagaatagcaatcctataagtatctgttgtcatccgcattcttctgatgaggcacagagagtaagtaacttgtccaaggccacacagctgctaagcaaaccagggttcaaacccaggctatctggctctggattctatatctttaaacaatcatattagactgctttcccagaacaaacaggataatcagaaattaaacattttgtcacaaggaatttctttcttcctttcttttctttttttttagatggagtctcactctgtcacccaggctggagtgcaatggcgcgatctcgggtcactgcaatctccgcctcccgggttcaagcaattctccttcctcagcctcctgagtagctgggattacagatgcccaccaccacacctggctaatttttgtatttttagtagagacggggtttgaccatgttggtcaggctggtctcgaacccccaacctcaggtgatctgcctgcctcggcctcccaaattgctgggattacaggtgtgagccactgtgcccagcctataatttccctttttttttttttttgagatggagtctcgctctgtcacccaggctggagtgcagtggcgcgatctcggcttactgcaagctctgcctcccaggttcacgccattctcctgcctcagcctcctgagtagctgggactacaggtgcccgccaccacgcccggctaattttttttgtatttttagtagagatggggtttcaccatgttagccaggatgatctcgatctcctgacctcgtgatccgccggtcttggcctcccaaagtgctgggattacagacgtgagccactgtgcccagcctagaatttcttacttataagataattctactttaaaatcagtatctttctttttgccccaaccagatgcccagggagccaacaatcctggaacgtagagggacttttacttgtgtagcatgatgcccaggaagggccctgcagttgatttgaggggttccaaaaagccccttaccaaaaaaatccttgtcctccctgtgaagcccacattggccattctgtattacttatttattttatttttttaattttatttatttattttttgagacggagtttcgctcttgttgcccaggctggagtgcaatggcgtgatcttggctcaccacaacctttgcctcccaggttcaagagattctcctgcctcagcctccagagtagctggtattttaggtgcctgccaccacacccagttaattttttgtatttttagtagagatggggtttcaccatgttggccaggctggtctcaaactcctgacctcaagtgatctgtccaccttggcctcccgaaatgctgggattacaggcgtgagccacttcacccggccctatactggccattttttaactttaagaagccaaagtttcctgtttaaatgagcataaattaaattttacatacagcttgatgtcaactacattagaaaaaggccaaaaggaaattatgagaatagcagctaccatggatgtgtcatacctttccccctgtgaatcgcaaagcacccattccacgatcggctctggaacgctctcagatatgcagaccagggcgtcctggttttccatttttctaaagtaaggtcttcttaatgtgtaaagcagggtatctaaagcatcataagttattaacattttactattttaaaaataattctcttagcagcccctcagaaaaggattctatgtcattatgaaaagttctcaaccattacgtatacatatttttttcttttttcataataaaggcatcaaaagcaaaccaaccattatattaaatttagctgtggctgcagtgtcaacttgaacatttctcctcttggccaatttctttgggtatttcacaaatccacagctaactaaagtagtcgagtgaagccatgtgaaaatacaaatattgataggcacaggaaaaaggaaattagcaataacatatggcttaaacccttgtttaacacatagtttagacctcaactttcttcctataatttgatctgcaactaggcagaaatatactaagatttagaaagacagaagaaacatggtagggtggagttggaattgcaacagaacttaagaggtttagttgagcctcccactcaccctggatcacacacacacacacacacacaccatccttcactcccagctatttctaacataaactttctacttctactttgactcttctagagactggagttcatgacctcccagggcaggtcattctaatttctgacaaacttttttttttttaaagaaagtttccctatactgaattccagcctctctccttacaataaattttgtttgaaaatactatgtactgtttgatatatatatatatatatgaaagaatatatggagtgtaaatttcaaagcataacaacaacaaatacccacggagccactatccacctaataactagaatattaataaataccttttgatctacttttatgcttctccccacctctcaactgcacgtatcctttatcctgaattttgttgattattcgaggactcttcaaagtagttataccaaataaatatgtggcactaaacaatatattgattttttcattcttgagcttcaaaatagtgttatcaatcaatatgtaacttctacaacttcattttttcatccaaccttatgtttttaaaattcatccatggttttacatgtagctatactttattcatttttttttttactgctacataatattctattggtaaatatatcattattttttcattttcttgcagtagacatttgggttgtttccttccgtgtgtgtgtgtgagacagggtctctgtcacccaggctggagtgcagtggtgcaatctcagctcactacagcctcaacctcccaggctcaagtgatcttcctgccttggcctcccaaagtgcttggattacaggtatgagccaccacacccggccacagttttttgtatgatcaaccatgtgctctgaacattctacacatttgtactgaggcatgtgtataacagtttccttaataacattcttaagagtggaactgctggtctacatggtatgagcacattcagccttacacataatgatcatttgttttccaaagtggttatactaatttatgttacacagcaggatatgagagcacctattgctttatagacttaccaagacttcttaattttcagcaatccagcaagtataaaatggtatttcattgtggtcttaatttaatttctccattattaatttaacatgtgttaaaataattaattgggagtccattaggctgagacaactctaacagcttgagttcctaggtaaacaaatcacaacacaactcaaaaaaaaaaaaaggaaaagaataaaggccgggcaaggtggctcacgcctgtaatcccagcacttagggagggtgaggcgggaggatcgcttgagcccaggagttcgagaccagcctaggtaacatgccaaaaccccgtctctacaaaaacaacaacaacaaaaagcaaaaaacaaacccaattcaatatgagcagcaaaatgcaacttagcttaatcaatgaggaactgcaaactgaccaatccagggactgtccttctttaaacaatcaaattttttctttgtcttgcttccgggaacacattatagaaagaagtcttacccttgaatctcctcactggagcccacctgcttgccatctggtactgcctgattcatgaattgctttctgctcaaatatactctttacaactttaaagtgcctaagtttatcttttaacatgtttcttgaccatttaggtttcatgttccaaaaatgaaatgcctactcatgtcctttgttcattgctctactaggttttcattttgttcgtttttcttattgacttattgacttatatagattgtttatcttattgactttacatattatgactattaatcctttgttgattgtgaactgcaagtattttttcccatcttgaggtgatttttactttttctccctgtaatttctaacaattggttcttatcatatcctctagagcaacttttttaaagtctagctttgattccatatgaaaatctttcaaatatttaaaatcagaaaccgagatcaagggagataattaccatacaaggtactttaactagttagctcaggtttcctgactcaaatcccaaaagaatttcctctgcattacactgcaatcaatcttatcgtctcctcaaaacatttccttctatatactacacattcccaattccttcaactgctcctaatttaaagaattccaagttttccactatcctggttgctcattttgtcagtattcatctttaaaaaagtagaactgaaatgaataagcttctattaatttccttaatttagacgttatattttcatgaacactgccaaggttcaaatttacttttttggcaaccatgccacgctggtggttaatactgagcttgtggttgactaaaccctttcctctttttcacactgactgttgccacatctctcccacctattttttggatcccaccaccttgcagaatgctaaaaataagttataatttacctgaataactgttgttacatttttacattgtaaatcttaagtgaaaggaatataccctaagtataacagagacacagcagatgcccacttaccttatacaactgtttatacttggcaagaaaattttaaaaggagagaaaaaaggagaaagaggaagagaagtagagaacaagaaacgtcctagcttcatccaacctggggcacgtatttactgtcccacagaggcggtgagggactagaaagggggcagggaacatgaccgacattaaagagcaacataaggtgattctcggctttggagcttgtagggctctggtcctatcattttcagagtaattaaaggactttccagaataaattttgggtaattttgactttagctcatgtataccttacaggctgactttagaaccttactccacccccaaccccagtaagatgatgcttctgggactcttgcgtgctctcttctgttagtagctttgacagcaagacccacacattctcacacaagacccagggcagtgtggtgcagaaagcctccagctgtgcccaccaccacacctctcagaggggctgttttctcatctacatgcatgcaggatcgctgtgagcatctgagatgaaacaggcagaagatcttcagcaaagggcagttgtggttactcctgacccagggcacctctgtgggccggacatttagtcactgacaaggaagaggggagcctggcaagttgtgtcaatgtgtcggggggacctaatttcaagtgatattaacccagggtttttggagcactgcactggcccctaaaggcacgaggacctaagtgaatgcagacacctttagtccttcttggtcatggaaggcgaagcagcaagttcagtgtgcatagcacggagtctgtgcatgatggggacgaaacaaggagaagccagaaagcacacgcaggtggtgcctctgccaactgcacagctgcctcccttggtcagaacatctggaccgttccttacagtttgcatatggtctagcacgcatgtgggcccgcgctgtccaacacagtagcccctagctgcatggggctatttacattccaattttaacaaattaaaattaaataaaattaaaactttagttcctcagtcaccttagccacctttcaagtgttcaacagccccatgtggccagtggctactgtattggaaagaacagacaagatcattttcatcatctcagaaagttctattggatcacgctgagaccttccaatcctgtgaggtacgtatttttatcctcattttaccaataaggaaatcggggctcagagaaattgtgacctgccataggtggtagtatcagaaccagaattagaacagaggtcttctgattccaaggtcaaaatgttttccatttcttccctgtcagccatctgctactgaacagaggacgtcccaggcgtttttagcagcagtcacattctgagagcccacggcacacatcagtgattcatcagtgattctcagttctctataggttctacagagggttgacaggaatctaatcaatccaactacgtatcaagggaaacctgaatatgtctagaggagctggtcaagctaacgggttctaaaccactcctttgaaatattgtggtattccaggctggaatactagtagcaggctggacttacttcttatactcactgtaaacaatattgtgtaattggtagcttcactctgaataaaaagtaggtattctccagcttgggtttctgtcattttcaaaatgaccatggaaacaactcctctgcaaaacaggaaagagaactagttattttggaaaatgtgtgaaactaaaaacaaaatttcatagtgactaaaaaggcagtttggtactccagcgttccccgactggcacggaagccgctctgtggagaacacagcttctgtcatgtgcccagcactcagcctgggcgttgctcgttgaaccctgacttttaaccagtcctccccttgagggtgggagagctccattccggtgccatcatctcaccttctctgagcttctaggatcgaaaactcccatctaaaaacacacaggaggccgggtgcggtggctcatacctgtaatctcagaactttgggaagccgaggcaggcagatcacctgaggtcaggagttcgagaccagcctggccaacatggtgaaaccctgtctctattaaaaatacaaaaattagctgagaatggcgcaggcgcctgtaatcccagctactcaggacactgaggcaggagaattgcttgaacccaggaggtaaaggctgcagcaagctcaggtcgcaccactgcactccagcctgggtgacaagagtgaaactccgtctcaaaaaaaaactgaaaaaacaacaacaaaagcacagtaagctgggtgcagtggctcacacatgtaatcccagaactttgggaggccaaggctggcagatcacttgagcccaggaggtcaagaccagcctgggccacatagtgagaccctacctctattttttaaaaattaaaaaaaaaaaacaaaaaaaaaaacggccaggtacagtggctcatgcctgtaatcccagcactttgggaggctgaagtgggtggatcacctgaggtcgggaattcaagaccagcctgaccaacatggagaaaccctgtctactaaaaatacaaaattagctgggtggggtggcgcatgcctgtaatcccagctactcaggaggctgaggcaggagaattgcttgaacccgggaggcggaggttgcggtgagccaagatcatgccattgcactccagcctgggcaacaagattgaaactccatctcaaaaaataaaataaaataaaataataaaataagttcacactttctgacctttagacccttaactgtgcaaagtgtagtctttctctaacagtgttagcatcagctgggagttgacaaagatgtagaatctcaggtcccactgagacctactcatcagaatctgcattttaaacaagatccccaggcaatccaaatacaggttatattcgagaagccctgctttaaagcagcaagcaggttcaatagaacatgggcctgcattcttaaacacagtcaattagcaggatatatacttgatttgcttctgcagatctattttgatgatatgctttttttctctgaaccattcgcctggcatgagccaccacgtctgcagtcgcagaagtttgggaggcgaggtaggaggatcacttgaggccatgagttcaagactaacctgggcaacatattgagatgccttcccaataaaaagaaaaaatgtggctggcactgtggctcacgcctgtaatcccagcacatttgcagccaaaaaacaagaagtgagtaatacaatcgcaaaagaggaaaggaaaatgaatgcgttccaagatttagaactcaacttcagaactatactcactgtcctgcaaatcacttaagagaagaatgtatttgaccttaaaaacaaatacaaataactggtacaagttgatcacagagacgttctccaagaccctatcaaggggcccgataccccttgcaggccatttgggtactgtttactacatagttcctggaaagcgcgtgccttctctacacctaagggacaacaggacagccacaagaatgtaaaagaaaggctgcgttaagagggcatttaattgacctatgtcctttgccccatctcatttcggcaagaggacaaggacagcagggggcagcaatcagcatagagctatacagggttaggacattacccacacatcttggctaagacatttttctggatgagatcgatgttcctcacagacagatcaatgtcttactaaataatctgtagatagcacataacattgcaattctgcttatcatattgtgaaacaaaatagataagatcaaatgttcttttcccaagcatttcccaagaataaatttcctttaaaaaaatttttttttaaagaatttcttggctggatgctgtggctcatgcctgtaatcccagcactttgggaggccgaggtgggcagatcaagaggtcaaaagacggagaccatcttgtccaacatggtgaaaccccaccgctattaaaaatacaaacattagctgggcgtggtggcaggtgcctgtaatcccagctactcgggaggctgaggcaggagaattgcttgaacccaggaggaggaggttgcagtgagccaagatcatgccactgcactccagcctggcaatagagcaagactctgcctcaataaataaataaataaataaataaataaataaataaataaatttaaaaaagaaatttcttgctacactaacaagaatgaaatgaaaactttctaaattttatctttaacatgatatccaactaaaaaacaagacacttaaaaaatcccaaatagacccagtgcggtggctcacgcctgtaatcccagcactttgggaggctgaggtgagtggatcacctgaggtcaggagtttgagatcagactggccaacatgatgaaaccctgtctctactaaaaatacaaaaaaaaaaaaaaaaatgaaaacaaaaaacattagccaggaatggtggtgggtgcttgtaatcccagctactcaggaggctgaggcacgagaattgcttgcagctgggaggcagaggttgcagtgaggtgagatcgtgccactgcactccatcctgggagacagagcaaaactctgcctcaaaaaaaaaaaaaaattcttaattgtaaataaggtaaaaatatttaaaaaaaaaaaaaagaaaaaggaaaaaaaatcctagatattcttttcactatttgttttacattttgccagccactcactgctttctatatacttatatatgtgtctgtgtgtataggtttaacttaatagacttgtttctttttttcttttttttgagacggagtctcactcttgcctctcaggttggagtgcagtggcgtgacatcggctcaccgaacatccccctctgggcttcaagctattctcctgcctcagcctcccaagtagctgtgattacaggcccgcaccactatgccaggctaatttttttatttttagtagagatggggtttcaccatgttgtccaggctggtctcgaactcctgacctcaggtgatcctcccacctcggcctcccaaagtgctgggattacaggcatgagccactgcacccaaccaactttactttttagagagttttagacttacaggaaaattgagcagaagacacagaaagatgccatatatgcccttccctccacacacagtttcccttattattaacatcttgtataggtgtgatatgtttgttacaattgatgaaccaattttaaagttcatagtttgggccgggcacggtggctcatgcctgtaattccagtactttgggaggccgaggtgggaggatcatctgaggtcaggagttcgaagccagcctggccaacatggtgaaaccccatctctactaaaaatacaaaaattagctgggtgtggtggtgtgcgcctgtgatccccgatattcaggaggctaagacaggagaattactttaacctgggaaacagaagtttcagtgagccaagaccaggccactgcactccagcctggatgacagagcgagatagttcgcattagggttcattttttgtgttatacatcctatgagatttgacagatatataatgtcatgtattgatgccctaactgtatttttagttcattatttcactgaagataagagttacaaaaaacaggccgaggccaggcgcagtgactcacacctgtaatcccggtacttttgaaggctgaggtgggtggatcgcttaaacccaggagctcaagaccagccttggcaacatggtgaaaaaccatggtgcctagaaaaaatttaaaaaattagctgggtgtggtggcacgcgcctgtagtcccagctacttgggaggactggggtggggggattacttgagcttggaaggtcgaggctacagtgagacaagattgtgccactctactccagcctgggtgacagagagagaccctgactcacaaaaaaaaaaggtttacaataaacatgaacagaaacttgaaacaaaattccaaatgaaccacattttatgtcaagaaggtattcctccacttacctgttttgtaaatcaaaatgtggctggcaattcagggagctgtgcttaaagacccagagacaggaaatgttccctggggcgtcgaccagcacttgcagtgtgatggaagcagatacatccacttccacagcggcagcttcgtacactgtccctgagctctggggtctcaacgcacacccgaggtcttccggggattctgatacctacgttgcagatagaacaaagtgaattcatgaaaactgcaggtctaaggcctccccttcttcacatcaaaactttatcaaacatatgcatgctgacacactgcacgcaacacccacacaagctggaacccactgagaacacgttgccgactgaaggtcctattaattataattctctaaagaaaagataaataacattgggctgcatttctaaaatgttgtacggactgtcatggcgtgtgtccccctacctctgcaagttcatatgttgaagtcctaaccctcaaatgcaactttatttggagatggtctttacagtggtaatcaagttaaaatgggtcattagggtgggcctaaatccagtatgactcgtgtccttataagaagaggaggcagggcacggtggctcacacctgcaatcctagcactttgggacgcggaggcaggcagatcacttgaagtcaggaattcaagaccagcctggccaacatggtgaaaccctatgtctactaaaaatacaaaaaataagctggaagtggtggttggcacctgtaatcccagctccacgggaggctgaggcaggagaatggcttgaacatgggaggcagcggttgcagcgagctgagatcgcgccactgcactccagactgggcaacagagtgaaactctgtctcaaaaaaaaaaaaaaaagaggagatttgaaggcagatacacagacagtaagaacaccatgtgaacagaaagacagccatcttccaaccaaggagagaggcctggagcagattcttgctcactgcccttagaaggaaccaaccctgctgacatcttaattttggacttctagcttccagaattgtgagataataaatttctgttggtttcagttgcccagtctgtggtagtttgttgtatcacccctagcaaactaatcagaccgtaattataaaatctataatatataggtaaatatttttgtgattgttggtatatagataaaaatttataaagcaatggtaaattggtatctgtgttagaggaaatttaaaaaccaaattttctgggcagatgtccccatagccacactgccaccacacttcttgcctgctttaaataattgagatatatgaggccaggcgctatggctcacgcctgtaattccagcactttgggaggctgaagtgggcagatcacttgaggtcaggagttcgagaccagcctggccaacatggtgaaaccccatctctactgaaaatacaaaaaattagctgggtgtggtggtaggcgcctgtaatcccagctactcaggaggctgaggcaggagaatcacttgaacctgggagatggaggttgcaatgagcctagatcccgccaatgcactccagcctgggggacggagtcagactctgtctcaaaaaattaattaattaattaattaagatatattgacagcaggggttggagcagcttctgctgtggagtcccccacctcctatctcctttacatggctgaacacagcatgcacacatgcacacacatgagcacacacatatttcttcaggtgaagagcagggtagctcttctgctaccagtcaaaaaccatatttctggtcttatttgttcacttactatgataagtgcaagaccatctgctgagtactatgagactagaaaaaaaaaaaagactaatcttgcccttaaagagtttgagtctcctaggaataaataagtaaaacacaggagaaatacaagtgtcccataaaaagataccaaatactttgaaatgtaaattgtaagtgccctggaacttcaaaggagggagaagagatttctaagccggatgtttaagtttttcacccaagtccagtaattgagctggatcataaaagatgggcacaagataaagtaaaaaataatagacaagtcaagcatggtggtacatgcctgtagttccagctactcaggaggctgaggtggaaggatcacttgagcccaggagttcaagtccagcctggagaacatagcaagaccccgtcccaaaacaaaaaaacccagctgacatactagaagaaaatatgccaacatatattacaagtaaagggcgaatacccctaatataaaaagaacctttgaaaattgagggacacagaaccaaaacacagtagacaactgggaaaaagaattgaatacacaattcaagaaaaaagatataaagaatggccctcagccaggggcgatggctcactcctgaaatcccagcactttgggaggccaaggtgggcggatcacaaggtcaggagttcgagaccagcctggccaagatggtgagaccctgtctgtactaaaaatataaaaattagccgagtgtggtggcaggcacctgtaatcccagctacttgggaggctgaggcagagaactgcttgaacctgggaggcggaggctgcagtaagccaagatggcactactgtactccagcctgggcgacagagtgagactccatctcaaaaaaagaaaaaaaagaatggccctcaagcatatgagaaaatattaaacctacttataattagaaatccataagttaaaacaagactaatatatcacttctcctctatcagactggcaaaaaattaaaaaatatgacaacacattttgtcggtgaggccatggggaaacagttttctcctgcattgctgggggaacacaccctgcacaacccttctggagaagaatttggcaatacctaataaaacttgcgattcactcaccatttgagccagcaatctcacttctgggaataagcacacctctagcaattaattgcagcacaattcataattgcaaaatactgaaaacaacctaaatgctcgtacatagatgagtggttgaacaaattatggtacatccacaccagggggtactatgtagctataaaaaagaatgaagacaacctctaagaactgatttgcaatgatttcctggatgtactgttaagtgaagaaagctaggtgcaaaaagtatctaccttcaagtatgctatgctatgtaagaaagaggagaatataaggaaatatatatgtatctggtcacttgtgcacaataaatactggaataatagcaaaacatctaaagggattggttaattacagggatatgtagaaagagggtggaaacttgtcagtaggagtgaggagacagtgatacttctctgagtatactgtttcacattgttttgacttttaggacaagagtcatgtcatgtctcaaaaaacaagtaattaaaccaaccaggagggtcaggcacagtggctcatgcctgtaatcccaggactttgtgaggccaaggcaagaggatcacttgagcccaggagttcaagatcagcctgggcaacaaaatgagaccccatctctacaaaaaattaaaaaattagccaggcatggtggtgcatgcctgtggtccttgctacccgggaggctgaggcaggaggattgcttgagcctaggaggttgaggctgaagtgagctatgtttgtgtcactgcactccagcctggacaacggagcgagatcttgtctcaaagtaataataataataataataataataataataataatccaggtgtggtggctcacgcctgtaatcccagcactttgggaggctgaggcaggaggattgcttgagcctaggaggttgaggctgaagtgagctatgtttgtgtcactgcactccagcctggacaacggagcgagatcttgtctcaaagtaataataataataataataataatccaggtgtggtggctcacacctgtaatcccagcactttgggaggccgaggcaggcagattgcttgagtccaggagttcgagaccagccttggcaacatggtgtaaccctgtctctagtaaaagaatatataataaataaaataaataaataaaccaactagaatatgtgaaatgagggggctggaagaaatatcaagacggaatacgaaccaaattaattcaattgtatcacaaataaataataacaccatagtgaagggatgggaaagaaaggaactaacctaagtaacttcagaaaataatactttggatcccttaaggctaaagacaaaaagcactgtacacaaatactgtcctttagttagtaaatctatttctcaccagggtatgggttagtaattctaaaattagattatctatatattgtatttccaggctctgcctgccgagagggcctagaagcaatgatatcccagcagcaatgggcacacccaactctcagatcttggttcctaaatactaccccccagagaagccagtgctctttggagaagtgctgaattccaggggtaaggcaagaaaagaaaaatacaagatgaacctgaactatctggtagtgtgtcaaaaattaaggaagggcttggaaaaagatgaggagatgttgaaaggacacaggagcaaaactgaagtagttcctaatggccaaagctggaagaatttgagcaacaaaataaataatgattgtattgggttacaatccagaggataaaataaatattcatgggcctctactgatataaataaaaaattgaataaatacataaataaaatgaggggaaaggggcagtgcttccttacaaagcattccaattaacatagagggaatgtaggaaaaagaaaagcaccattaggcaaacaccaccataataatcgtaggcaagatccaccaatgggtgctaaaatcagtaggtgaaaattaaagaaggaacaggatatttgcatcccctccaagacacttattaattataagtgaagaaaatagtaactttgcagtggggatacctggcatgcactgtctaactctaatgatcaaggttcacatcttcataatgacaccaaatgacttcctgtcactctgaatatgatgctctgggaagggcacgctcctgggaaattcttgccagaaatccataatctcgttcttgttgccaggctggagtgcaatgcatgatttcagctcaccgcaacctccgcctctggggttcaagcgattctcctgcctcagcctcttgagtagctgggattacaggcatgcgccaccacgcctggtttattttgtattttttagcagagacggaatttctccatgttggccaggctggtctcgaactcccaacctcaggtgatccacctgcctgggcctcccaaaatgctgggattacaggcgtgagccaccgtgcccagcccctgtaaaaagtttttaaaaattaaagctgggtacaatccacaatctggatagacaaatctgcgggcttcagaggagagagaatagcatgataaatgcacagtacagaggcagtgggctccaccgctggcagtccgggaatagcttgagccaggctgaccaggagccaagggatgttcttgaaggccaggccacgttcttcaccacctggcagagctgagtcccacagagccatgaaggcactggaatttaagagactgtgatatctcaaaatcacaatgttaaaaaaaaatacaacttttgtaataacactgaaattcagtctgttgatcttcttataacaagtatagctaactaatgaggacatgaaatcactaacacagttgttgtctgcttacgtaagtaaaacagctgcacaagctgtgaaaagtccagagaaagcacgtaaaatgatccatcacacaaagtccaccattctttcccaaatccttgttacagaaaaccaaccaacaaacaaacaaatcaacaactcattctctagaagtacagggtgggacatggcaaataaagaaaataagctggcttgtgcaggccacctgcctgaaatatgaggtcatgattgtcaaacacatttggtcaactccagtaacttcagttcttcacaaagagaaaaccagtcattaaaccatagtggagactttttgtttttattatttttgtttttattatgttttgttttgttttgtttagactgtgccgcaatggcacaagatctgttcaggaggaatgtgacattaaatgcagctttgactttctggaggaagggaggtataaatgaacctatttggtaaggagagataattttagagttatggtggattgcctgcctatgctctctaatcactgacaggaaaaaaaaaacagtacatctcactcagctgctgtgaatacttggtgccttagtatagtcatctcttaaaagcaaatttgaagaatatggaatagttggtgatatggtttggatgtgtgtcccctccaaagctcatgttgaaacgcgattcccagccaggtgcagtgagtggctcatgcctgtaatcccagcactttgggaggccaaggtgggcggataacctgaggtcaggagttcgagacccatctggctaacatggcaaaacccgtctctacaaaaaaaaaatctatgatatatatcatatatatatatgagatatatatcagccagtagcagtggctcatgcctgtaatcccaacactttgggaggccaaggcaggctggagggcagtggcacaatcttggctcactgcaacctccacctccctggttcagatgatcctccggcctcagcctcacaagtagctgggaccacaggcgcacaccaccatggctggttaatttttttgttgttgttgtatttttgatagacacggggtttcaccatgttcctcaggctggtctcaaactcctcagctcaagcgatccacccaccttggcctcccaaagtgctgggattacaggtgtgagctactgtacctggctgatttctactattttcagttctccatcacttaagcttcccttgagtaaatttactaaatatatgtttttaaaatagaggggtaggaatagcacaagagagggggtaatgaaaaacaagacgaacagcgtaaaagagaggagtcatgaaaaacaaagtcggaacttgaaggagccagagccagattactgagcaatcttggtatcagtctaagtaatgggaaatcatggagggttcagagccaggcaatgaaggatgtgcctgcttcagggaggctagcccagcagctacctctgagatgaattgtagcaggaagaggccacttaggatatcactgtgattatgagggagttaacgagggcttgacttagggaagtggcagtgagactagagaatatgagatgattatatgagaactcctaaaggggatcgacaacacttggtaactgaccaaatgtgaaagtaatagaaagaaagtagtccaaaatgatgctgagctttcaagcctgggaactaaacaggggtataaacagaaatcaataaatacaagaataagagcaggcttggggaaatagaaatgaaataaaataaatgacataggtggattttgatgtgcaaatggaaaatctacctatatactgggggcagctggaagtgagggattcaggcttggaagaaaagccaggattctctttaaggagaaaaggaaatacagtaggccctctgtaaccatgggttccgcatccatggatacaaccaaccacagattgaaaatattccgaaaaaaatggggttgcatctgtactgaacatgtaccgacttttttcccttgtcatcattattccctaaacaatagggtataataactattcacatagttgtttaggtattataaagcatttgcatcgtattaggtattataagtaatctagagataattttaaaagtatacaggagggtcaagcatggtggctgaggactgtaatcccagcactttgggaggcttaggtggtaggatcagttgagcccaggagttcaagatcagcctgggcaacagagtgggaccccatctttgcaaaaaataaaaaaaattagccaggtgtggtggcatgtgcctttagtcccagctagttgggaggttgaagtgggaggattgcttgagcccgggagggcgaggctgcagtgagctatgatcatgccactatactccagcctggtcaacagaatgagactgtctcaaaaatatacagaatctgcataggttacatgcaaataccaagccattttatatcaggtacttgagtatccatggattttggtattagtgagagtcttggaaccatccccgctgtataccaagggacgactctactcattacttcatgctagttatcaatcagtgtccttcctaaatcctcatatgaagaatacggttcttgaaggaatggagtgccagggagctaggagtatagatgctctgttggtaccagatgtgaggccataatatacttaaatacataaagagaagcccatttagccatggtaggcttcaataacttacaaattacgttctctagagaaaaacagctaaaggtataattttaatgttactttaccatgggatatgatgatgacttccccactgatgaatcattgttcttatgattgattaaaacacacttgatcacaggcagatcttgatttgtaatagtcccaaatatcattgcagaaaaaacaactgtaaaacaaaataaaaatgataatgttgatacatgcacaccttaaaaagaaaacatgcatttatcttgcaaccaaacaacaaaacaaagtgtaatcagaggaaattggccactatgaaagtatgtaggaaatttgattttatgcaagtttagtctagtttaaatcaggagcagagatacttagagcagggctgtccaataaaacagtctgcagtgatggacatgttctatgcctgtgctgtctaatatggtagcgactagctacatgtggctcttaagcttttgaaatgaggctagtttgactgaggaaatgattatttgtatacatgatttgtgtgtgtgtgtgtgtgcactttttattgtatatagatttctacctttttttttttttttttttttgagatggagtctcgctctgtcgcccaggctggagtgcagtggcgcgttcttggctcactgcaagctccgcctcccaggctcaagtgattctcctgtctcagcctcccgagtggctgggattacaggtgcccgtcaccgtgcctggctaattttctttctttttttttttgtatttttagtagagacggggtatcgccacgttagccaggctggtcttggactcctgacctcaggtgatccacccgcctctgcctcccaaagtgctgggattacaggtgtaagccactgtgcccggcctggtatattctttttttctctatgggtgcttatagaatcttttctttgaaaccacagcactaaaattttcaaaattatgtgccttcctgagagtctattttcatccattgtgctgggtactcagtgggccttttcaatctagaaattcatatccctctgtttggcattttcttgaattatttctttgattccttctctcctctttactttctgtttgcccatgatttagatattttccccaaatgactgacaatctttgacagtctcttcacatataagaatgaagtgctgagcgtctatcctaagctctatgatgtggcttgtggctcaatctctgtaggtgtatatttaggtcttttctcaccggttggtccgactccccagagaagattctctctcttgcttgctgcctgtgtcctgcgagctggtcttggcaagttatactattgtggggtcctgcaatgaaaagcaggctgcttctcagctttctcaacccccaactataattcagctttcatcatctgcttcttctttttaattttttttttaagagacaggatctcgctatgttgcacacagtgacttcaaactcctggactcaagtgatccccctgccttggcctcccaagttgttggatgataggtgtgagccactacacccagctttatctgctttaaagctctcaaagttttactttctccttctccaccctctttgtctttctatgtttatatctttgtttctttgggggtattaggtataattggcaaataaaaattgcagtgtacatcatatattcacagtgtacatcatgtaattttcatatatatataaaaatatatgtgtatttatatataatgtgtgtatgtatatgtatatattaagtatatatacatatatatgggcttctctttatgtatttaagtatatatgtacatataagtatatacacatatacatacacacattgtgaaacgaataccccaaacaagctaactaacctatccatcagcttgtatacttatctttttctttttcttttttggtgatgagaacatttaagatctactctctctcgctctctctctctcttttttttaaattgagacagagtcttgatctgttgccgaggctggagtgcagtggcacgatcactgctcactgcaacctctgtctccggggtttgagtgattctcctgcctcagcctcccaagtagctgggatcacgggtgtgcgccatcatgcccagctaattttcgtgtttttagtagagacagcattcaccttgctggccaggctagtctcaaactcctggcctcaagtgattcagctgccttggcctcccaaagtgctgggattacaggcatgaaccactgtgcctggccaagatctattctcttaacaaatatgcggccgggcgtggtggctcacacctgtaatcccagcactttgggaggccgaggcgggtggatcacgaggtcaggagctcgagaccatcctggctaacgtggtgaaaccccgtctctacctaaaaaaatacaaaaattagccgggcgtggtggcaggcgcctgcagtcccagctactcgggaggctgaggcaggagaatagcgtaaacccgggaggcggagcttgcagtgagccaagatcgtgccactgcactccagcctgggcgacagagcgagactccgtctctaaaaaaaaaaaacaacaacaacaaatatgcttatctctttaaaagcattttttggccgagcctggtggctcatgtctgtaatcccagcactttgggaggctgaggtgggtggattgcttgaggccaggagtttgagaccagcctgggcaacccagtaaaagcatatctctaaaaattttttttaaattaactgggcatagtggtgtgcgcctatagtcccagcccagctactcagaaggctgaggtgggaaaggatcgctcaggcatgggatgttgaggctgcagtgagatgtgattgcaccattgcactccagcccctgggtgacacagtgagacctcatctctggaaaaaaaaaaaaaaaaagcattttttactgtcacttgagtggtctgtagatagcgacaggaggtaatatatgtgtccagccatctttgtaatctcataatctgagacagtctcagaaagtaagaacttttcctgctccactctgtaatgttttctctctagtctttaaaaaaatagtaatttaaaaaatattttataagtataattaacttataataaatcgtgcacattaaaagtatacaatttagtaaattcatacatatctgcaaatccatcaccacaatcaaaatggtgaatttaaggctgggcatgatgctcacacctgtaatcccagcgctttgggaggccaaggtgggaggatcacttgagaccaggagttagagaccaggctgagagatagagtgaaaccccatctctacaaaaatttgtttttaaaacattagccaagtgtggtggcacgagcctgaagtctcagctacttgggaggctgaagtgggaggatagcttgaggccaggagtttgaagctgcaatgagctatgatcacgcctctgcactccagcctgggcaaaagagccagatcctgcctctaaaaaaaaaaaaaaaagaaaagaaaaaaaagaaaacaattttttttaaaagatagtaaagttacctatcactctcaaaagtttccttatgaagctttgatatcacgccctgctaccaaccccattcccccacacccaagccacctctgatctattttctgtaattatagactggtttgaattttctaaaatttcatacaaatggaatcacacagtatgaactgtttttttatagggtgggtggtctggcctctttcattgtgcatttttttgatatttgtccatactgtagtagatatcagtagttcattccttttaattaccaagtagtaatctgttgtatagatatataacacaatttgttttaatctattcacctgtggacacacatttgggctgtttccacttttgctgttactaataaagctgctatttatataaaagtcttaatatggatatatactttcatttctcttgggtaaatactaaggaattgaatgcctaggttatatggtcagtgtatttgtaactttttaagaaagtgcccaattgtcttccaaagaggttagagcttttatgttcccactcgcagtgtatggaattccagttgtgtcacatcctcgctaacatttggtatgatgagactttaaaattttggcctttctaataagtgtgttgtatctcattgtgttcttatttatttttattttttattttttgagacagggtctcaccctgtcactcaggttggagtatagtggcgtgatcacagctcactgcggccttgacctcctgggctcaagccatccccccaccttagcttcccgagtagctgggacaactggtgcgcaccaccatacctggctaatttctgtatttttgtaatttttgtattttttgtccaggctggtctcaaactcctaggctcaagttgtctgcccaccttgggctcctcaagtgctgggattacaggtgtgagccactgcgctcagccctcattgtggttttaatttgcattttcctcctgactaatgaacattgaacatccatttagatgatgctatcacattccataacttctctggtggtgtatctgttcacatcttttgcccacatctaaccttttttaatgagattgctcattttaaaaagtattgagtattgtataattgacaaaaatatatactcacggagtataatgtgatgttttaatatatgcatacattgtggaatgattaaatcaagctaattaacatatacatcattgtggttttgatttgcatttccctgatgattagtgatgttgaacattttttcatatatttcatatatttcttggacttgaaatgttcccaacacatagaaatgataaatattcaacgtgatgattacctcaaatactctgagttggtcattacacattctatggaggtcacaaaatatcgtatgtaccccataaatatgtaaaatattatgtatcaataaaaaatagatgcatcacaaggccgggcatggtggctcacatctgtaatcccagcactttgggaggccgaggtgggcagatcacttgaggtcgggagttcaagaccagcctggccaacatggtgaaaccctgtctctactaaaaatacaaaaattagccgggtgaagtggcgcatgcctgtagtcccagctactcaggaggctgaggcagaagaatcacttcaacctgggaggtagaggttgcagtgagcagggatcacgccattgcactctagcctgggcaacagagtgaggctctgtctaaaaaaaaaaaaatggatgcatcacttcatgtatttattttttcatgttgagacatctaaaacctactctcttagcaattttttttttttgagacagagtctgactctgtcacccaagctggagtacagtggcaccatctcggctcactgcaaactccacctcccaggttccagtgatcctcctgcctcagcctcccaagtagctgtgattacaggcatgcaccaccacacccggctaattttttgtatttttagtagaagtgagggtcccccatgttggccaggctggtctggaactcctgacttcaagtgatctgtccgcctcggcctcccaaagtgctgggattataggcgtgagccactgcacatggcccttcatagcaattttctcatatacaatgcatttttaaaatatgagcattttgacatttatttattcatccatccatgcaattaacaaatattaagtacctacaatggccccaaaaagagaaaatatattacaaaacataatcaaatgctgacgtttattttatttcattttacacaatacatttgtagtagccttctccagagggacaaaaccaataggatatatatacatatatttcatatatttgtatatgaaagggaattttttagagagaattggctcatgtgattacaaaggcgaagttccaggacaagcggtctgcaagccagaaaatgagaaagaaaagccagtaacgtgtcccagtccaagaccaaaagcctcaaaaccaaggaagccaacaatgcaaccccagtctgaggccaaaggcctgagagcccccagaaggctgctggtgcaagtgtcagagtccaagagccaaagaacctggagtctgatgtccaaaggcaggaggagaaaaggtgttctactccagaaggcagagagaaggcagtgtttgtagcatgagtgaggactgtaatctcagcactttgggaggccaaggtgggaggattgcttgagcccaggaattcgagaccagcctgggcaacacagtgaaactctgtctctacaaaaaatacaaaattagccaggtgtggtagcatgtatctgtagtcccagctactcaggaaactgaggcaggaagatcacctcaacccagggaggtcaaggctgcagtgagctgtgatcatgccactgcacttcagcttggatgacagagtgagaccctgtctctgggtgacagagcaagagggaaggaaggaaggaaagaaggaagggagggaggaagggagggaagagacagacagaaaggaaggaaggaaggaaggaaaagaaagagagagagagagaggaaggaaggaagggaaagaagaaagaaaagaaagaaagaaagaaaaagagaaaaagaaagagagagagaaagaaagagaaaagaaagaaagaaaaagaaaacaaaagaaaagagagttttatttggctcacagttacatagtgtgtgtgagaagcatgatgctagcatctgcttctggtgaggaactcaggaagcttcatatattagtccgttttcacactgctgataaaaatatacccaagactgggaagaaaaagaggtttaattggatttacagctccacatggctggggaggtttcagaatcatggcaggaggcgaaaggcacttctcacatggtggcagcaagagaaaaatgaggaagcagcaaaagcagaaccccctgataaacccatcagatctcgtgagacttattcccatcaaatctcgtgagacttattcactatcatgagaatagcatgggaaagtctggcacccatgattcaattacctccccctgggtccttcccacaacacgtgggaattctgcgagatacaattcaagttgagatttgggtggtgacacagtcaaaccatatcattctgccccggcccctccaaatctcatgtcctgacattccaaaatcaatcatgccttcccaacagtcccccgtagtcttaactcatttcagccttaacccaaatgtccacagtccaaagtctcatctgaggcaaggcaagtcccttccacctatgagcctgtaaaatcaaaagcaagctagttacttcctagatacaatgggggtacaggcattgggtaaatacagctgttccaaatgggagaaattggccaaaacaaaggggttacagggcctatgcaagtctgaaatccagcaaggcagtcaaattttaaagctccaaaatgatctcttttgactccaggtctcacatccagggcatgctgatgcaagaggtggattcctatggtcttgggaagctccgcccctgtggctttgcagggtacagcctccctcctggctgctttcatgggctggcattgtgtctgcagcttttccaggtacatggtgcaagctgtcaatggatctaccattctagggtctggagggcagtggccctcttctcacagctccagtaggcagtgcttcagcagggactctgtgtgggggctccgaccccacatttcccttccacactaccctagcagaggttctccatgaggaccctgcccctgcagcaaacttttctcagggcaaccaggcttttccatatatcttctgaaatctaggcagaggttcccaaatctcaattcttgacttctgtgcacccgcatgctgaacaccacgtggaagctgccaaggcttgtagcttccaccctctgaagccacagcctgagctgtacattggtccctttcagccatggatggagctgctgggacacagggcaccaagtccttggctgcatacagcatggggatcctgggctcagcccatgaaaccacttttttctcctgggcctctgggcctgtgatgggatgggctgctgtgaaggtctccaacatggcctggagacattttccccatggtcttggggattaacattaggctccttgcaacttatgcaaatttctgcagcagctagaatttctccccagaaaatgggtttttcttttcttttttttttttttttgagatgcagtctcactctgtcacccaggctggagtacagtggcaccactttggctcaccacaacctccgcctcccaggttcaagcgattctcctgcctcagcctcccaagtagctgggactaaaggtgcacgccatcatgcccagataatttttgtatttttagtagagacagggttttactgtgtttgctaggctggtcttgaactcccgacctcgtgatccccccgccttggcctcccaaagtgctggggttacaggcgtgagccaccatgcccggcctgggtttttcttttctattgcataatcctgctgcaaattttcccaacttttatgctctgcttcccttacaaaactgaatgcctttacaagtactcaagtcatctcttgaatgtgttgctgcttagaaatttcttcagccagataccctaaatcatctttctcaagttcaaagttccacaaatctctaggacaagggcaaaatgcctccagtctttttgctaaaacataacaagagtcatcacctttgctccagttcccaacaagttcctcatctccatcagatagaccacctcggcttggaccttattgttcgtatcactatcaggatttttgtcaaagccattcaacaagtctttaggaggttccaagctttcccacattttcctgacttcttctgagccctccaaactgttccaacttctgcctgttacccagttccaaagacacttccacattttcaggtatcttttcagcagcaccccactctactggtaccaatttactgtattagtctgttttcatgctgctgataaaaacatacctgagactgggaagaaaaaggggtttaattgggcttacagttccacatggctgggaggcttcaaaatcatggtgggaggtgaaaggcacttcttacatggtggcagcaagagaaaaatgaggaagaagcaaaagcaaaaacacctgataaacccatcagatcttgtgagacttattcactagcacaaggatagcacgggaaagaccagcccccacgattcaattacctcaccctaggtccctcccacaacatgtgggaattctgggagatacaattcaagttgagatttgggtggagacacagccaaaccatatcacttccactcatgacagaaggggaaagggagcagccatcacatagtgagaaaggaaggaagagagaggagggggatgccaggctctttttcacaatcatgtcttgtaggaactagtaaaatgagaactcactcattcccacaggatgacatcaagccactcacgaggtatccacccccaggacccaaacacctcccactaggctccatctaaaacactggggatctggccgggcacggtggctcatgcctgtaatcccagcactttgggaggccaaggtgggtggatcacctgaggtcaggagttcgagaccagcctggccaaaatggtgaaaccccgtctctactaaaaatacaaaaattagctgggcgccatggcgcattcctgtaatcccagctactcaggaggctgaggcaccagaattgcttgaacccaggaggtggagattgcagttggtggagatcgcaccactgctctccagccttggtgacagagagagactccatctcaaaaataaataaataaataaaacattagggatcaaatttcaacatgagatttagagcaaaaaatatccaaactatatcaacattattatcagctatagtcatcatgctgtacaatagatatccagaacttaccctcctaactgaaactttgtattattgagttttgagaggttaaaattatatatattctggatacaagtcctttatcacttatgtaattggcaaatattttctgccagtctgtggcttgtttttagaggatcagaaatttttaatcttgaagatgtccaatttatcaatttttcttttatggatcatgcttttggctttgtatctaaaaaatcttcacctaatcttaaatcagaaaggttttctcctagaagtcatatttacatttaattttatatttaggtctatgatccattttcaattaacttttcatacattatgacatatggatcaaagttttgcacatgaatatgccattgttccagtaccatttgttgaaagactgatttctccactgaattacctttacacctttatcaaaaataaattgaccatatatttttggtcagtttctaggtcgcaaatcactatactgttccattaatctgtttgtctatctggatgccaattccacattgtcttggttactactgctttataataagccttggaatctactacaaattctctaactttgttctttagagttgttttggatattctagttctcttgcatttccatatgaattttagaatcagcttgtcaatttctgcaaaaagatctacagggattttaaaaggaatttcactgaatcactagatcaatttgggcaaaactgacattataacaatattgagttttctaatacataaatatggcatatcactccttttaattagatcttacttaatttctcttatcaatgttttatagttttcattatgggtcttgcccatctttctccctgtttcatatttttggatactattttggtattcttcccttcaatttctgattgttagttgctaggacatagaaagataattaatttttttccacactgatagtacatcctgcaaacttacagaactcacttattagttacagtcactttttgtaggttctatagaattttctacataggttatcatgttgtctgtaaataaagagttttacatcttccttttcaatctggatgcttttcatttctttttcacgtcttaatacgttggctaaaatctgcagtataaagttgaataaaagaagtgaagagtggatatcctcgccttgtttctgatcttagggaaaagatttattaatttactatgaagtataatattagctattggtttttcatagatacccttaattagcttgaggaagataagttcttttctcttctgtaatatttttattataatttttactttgatttactttgatttttttactttgattcttttttttttttttttttttttttttttgtgagacacagtcttgctctgtcgcccaggctggagtacaatggtgcgatcttggctcactgcaacctccatctcccgggttcaagcaatttttgtcccttagcttctgagtagctgggattacaggtgcccaccatcatgcccggctaatttttatatttttagtaaagacagggtttcgccatgttgcccaggttggtctcgaattcctgacgtcaggtgatctgcctgcctcaccctcccaaagtgctgggattataggcgtgagccactgcaccggcctactttgattcttataggcaggatcttgctctgtcgcccaggctggagtgtagaggcattatcatagctcactccaacactgaactcctgggctcaaacagttttcccacctcagctgcccaagtacctaggactacatgcacataccaccacactcagctaatttttaaaaaattgtttaactttttgtagagatggggtcttgctatgttgccaaggctggtctcaaactcctagcctcaagcaaccccccttgcctcgtcctgccaaatcactgggattacaggcatgagccactgtgcctagtcttttattttttgttttttctgctgctcactccaggaggaatttttttttttgagacatgatctcactgtgtcacctaggatggagtccagtggtgcgatctcagctcactgcaacctccacctcccatgctcaagggatcctccaaccttggaagggacgcttccaagtagctgggactacagtcaggagccacgacgcccagctaatttttgttttgttttgttttgttttgttttgttttgttttgttttgttttttgagacggagtcttgctctgtcgcccaggctggagtgcagtggcgcgatctcagctcactgcaagctttgcctcctgggttcacgccagtctcctgcctcagcctcccgagtagctgggactacaggcacccaccaccatgcccagctactttttttttgtatttttagtagagacggggtttcactgtgttagccaggatggtcttgatctcctgacttcatgatctgcccactttggcctcccaaagtgctgggattacaggcatgagccaccgcgcctggccaatttttgtattttttgtagagatgaagtttcaccatgttgcccagtctggtgttggtctcttgagctcaggcaatccttacaccttgtcctcccaaagtgctgggattacaggcatgatccaccacgtgcccagccgaatcacttctatgcctagtttgctaagaggtttttgtcagtaatggatattgaactttgtcaaatgctttgtctgtatctattgagataatcagatagacttggttttgttctttttttttagtaataattttctttttagtctgtaaatatagtgattgattttcaaatgttaaccaaccttgcattcctggaataaacatcagcgggacatcacctgttatcttttttatatatcattgaattcaatttgttaaaatattactaaggattgttacatttacactcatggaagttattgatctatacccttcttttaacctttgtctggttttggtattagagtaatgctggcttcatagaatgagttgagaagtgtcgccttctcttcagttttctggaggagtctgtatagaattggttttatttcctctttaaatgtttggtggatttcccagtgagagccatctgctctaataattttccttgtgggaatatttttaactacagattaaattgctttagtagagcattatttagcttatcaatttttcttgaacaagcattgatagtatgtgtcttttattttttttctgttaatcaaagttgtcaaagtataggtataaagttgttagtaatatttccatattaaccgtttaatatctgtagattatgtagtgatactacttctctcattcctgatattggcaattcacgtcttcactctttttttctaatcagtttggctagaggtttactgattttattgatcttttactgttcttagttttattgttttaatttctaatttttttgttttctttttctttgatttttcaccctgatgattattactgtgtttcctttcttttgcttactttttttcttttttttaaaagaaatggtgttttgctgtgttgccttggctggacttgaactcttaggctcaaatgatcatcccacatcagcctcccaactagtgaggactacagacataggccaccacgtctccctaatttttttttattttttgggagacgaggtcttgctatgttacccaggctggtcttgaactcctggcctcaagtgatcttgccacctcagcctccaaaaatgctgggattacatgcgcaagctactgtactggcctctttctgttattaattttaattaattaattttttatttttttacaaaaatgtcctgcagttattaattttgtttgttttttgttttgagtctcactcgtcacccagggtggactgcagtggtgtgatcacggtgtactgcagccttaacttccctgggctcaggtgattctcccacctcagcctcctgtgtagctgggagtacaggcaaatgccaccaacctggctaattatttttttctaatttttgtagagatggggatttgccaccaacctggctaattatttttttctaatttttgtagagatggggttttgccatcttgcccaggctgaaattttaatttaatgctattgtagtcagaagatatactttgtatgtattgaatcttttaaaatttacagccgggcgcagtggctcatgcctgtaatcccagcactttgggaggccgaggagggcggatcacgaggtcaggagattgagaccatcctggctaacacggtgaaaccccgtctatactaaaaatacaaaaaattagccgggcgtggtggcgggcgcctgtagtcccagctactcgggaggctgaggcaggagaatggcgtgaacccgggaggcggagcttgcagtgagccgagatcgcaccactgcactccagcctgggcgacagagcgagccttcctctaaaaaaaaaaaaaaaaaaaattcactgacacttgttttatggttcagaatatgctttaccttggtaagtgtgcacctgaaaagatgtgcaagccggggcggtggctcacgcctgtgacacctcactttgggaggccgacacgagcggatcacctgagaaaggagttcaagaccagcctggccaacgtggtgaaaccctgtttctactaaaaatacaaaaaattagctgggcctggtggcgcacgcctatagttccagctactcgggaggctgaggcaggagaactacttgagccggggaggcagaggttgtagtgagccaagattgtgccactgcactccagcctgggcaacagagccagactccatctcaaaaaaaaaaaaaaaaaaaaaaaaagaaaagaaaaaagaggtgcatttgactactgtgactattgttaggtggaatgttccataaatgtgatgtggtcaagttgcttgacaatgctgttcaagtcttctatatcctacttatttatttgtccttgttctatcaattattgaaggagaaggagtgtcatacactttgaatataattgtgtatttgtttatttctccttgcagttcagtcagattttgccccatgtattttcaagttctgttattaggtgcatacgtttaggattgttatgtccttttgatgaatcaagccttataacattatgaaatggctctctttgtttctagcaatattcttttctctgaaatgtactttgtctaacatcattacctctggctctcttttgattagtgttagaatgggatttttttccccatccatttacttttaacctatttgtgtcttcatatgcaggactagggctgggcatggtggctcacacctgcaatcccagcacctcgggaggccaatgtgggcagatcatttgagcccaggagtttgagaccagtctgggtaacatgacaagaccccttctttaaataaaaaattacattaaaaaaatatccaggactggtttcatttatgatgcatatagttgggtcttacttttctttagccaaatctgaaacttctgctttttaattatgatatttagatcattttaacttacagaaagtattgacatgatcagatttaaatctactatattgttctttgttttccatttgtcccttctgttttttattctttcttctcttttttctgcctcctttgggaataactgagcttttaaaaaaatgattccactttatttccttttgtggattattagctataatgctttgttttgttttagtagtcgatttaaggttcatagtattacatgtttaccataacacagtctacctttaggtgatgttacattacttcgtatctaatactaggaccttacactggcatatttccgtttcatttctttcaggctttgtggtattgctgacatacactgtacttctacgtaagctataaaccccacaagacattattattattattgctttaaacagtgaattgtcttttaaagagatttaaacaataagaaaaaaaggctatacttactcaaatagtttccattcccactattttgtattcctttgtgtaaatccagattttcattttgtattatttttccttctgtctgaagaactcgtgtgtgtgtgtgtgtgtgtgtgtgtgtgtgtgtgtgtgtgtgtttgagatggagtttgctctgtcactcacactggagtgcagtggtgaaatctctgctcacttcaacctccgcctcccaggttcaagcaatacttctgcctcagcctcccgagtagctggaattacaaacttgcacaatcaaacccagctaatttttgtatttttagtacagatggggttccaccatgctggccaggctggtcttgaactcctgacctcaagggatctgcccaccttggcctcccaaagtgctaggattgcaggcatgaaccaccatgcccacctgtctgaagaactttctttaacagttcctattgtgccagtctggtagtgattgtttctttcagtttttgtacatctgaaaaactatttgtttctcttcatttttgaaagtgttttatttttggatatagaactacacatttatattattagttttgctctgttgtccaggatgaagtacagtggcatgatcatagctcactacagccttgaactcctgggctctagcaatcctcctacctcagcctctgaagtagctttgactacaaggacacaccatcatgcctggccaattcttttatttttcgtagagacagtggattgctatgttgcccaggctggtcttgaactccttgcttcaagcaatcctcctgcctcagcctcccaaagcgtccttcagttctttaaagatgttgcaatgtttcttcactgtcttttgacttacatagttcatgacaagaagtctgccaaatgaatgtatctttttttctctggatgcttttaagattttctcttagtctctggctttaaccaatttgatgataattagccttttgtagttgtcataagtcatgtgtttgagtttcactgggcttcttgaacccataggtttatcatttttatccgattttgacaattttcctcccttatttttgacatatctttactgtcatcttcctttcctccattctctcctttagggactctaattacatgtatatctgacgacctgaagttctgtacctccctaattctctgtttacgttatttggtcttttttgctctgttcattttggatagtttctgttgctatgccgccaagtccactaatcttttctcctacaatgtttaatctggtactaattctctccagtgtaattgagttttcatccttagtagttcaatttgagtaatttgttatatttgctatgtctcttcttaacatgtacaatctttcctcattcagaaagatttggaatattgttataataaccgttttaattttcttgcccactaattccacatttgatgtcatttctgggtcccttttgggtgactgatttttctccttaagttaaatatttcttgttccttgtttgtctagtaaatttataactgggtgtcagacattgtgaattttacctggtgctggatgtttttgtcttctgttaaatattcttgaacttttttctgggatgcaattaaatttatggtgagcactttgttctttcatgtcttgcatttaagctgggttaggtgggatcaaagcagtgttcagtttagagttaattttcttttactagtggacttcaccaaaatgaaaaacttttgctcctcagaaaacattctttttttttttttaagacggagtctcactctgttgcccaggctggagtgcagtggcacaatctcagctcactgcaacctccacctcccaggttcaggtgattctcacacctcagcctcccaagtagctggaattacaggtgcacaccaccatgcctggctaatttttgtatttttactagagacagggttttgccatgttggccaggctggtcttgaactgctgacctcaggtgatccacctgccttggcctcccaaagtgctgggattacaggtgtgagccatccaaaacctttttttttttttttttttgagacagagtctcacactgtcacctgggctggagtgcaatggtgcgatcttggctcactgcaacctccacccccgggttcaagcgattctcctgcctcagcctcccgagtagctgggattacaggcgcccaccaccacgcccagctaatttttttgttttttcgtagagacggggtttcactatgttggccaggctggtcttgaactcctgacctggtgatccgcctgcctcggcctcccaaagtgctgggattacaagcgtgagctgcccacccagcccagaaaacattcttaaaaaatgaagacaagccacagactggagaaaatagtttgatgatatacatgtgaaaaaggacttgtatccataatatgcaaagaacccttaaaacccaataataataaaacaaacactccagttttaaaaatgggcaaaagattttgggagacacttcaccaaacaaaatataggatgacaattaaacacatgaaaagatgcttaacatcattagtcattagggaaatgcaaatttaagccacagtacacattgctacactgctattagaatggttaaaaacccaaaccaaaaaactgacaataccacatgctgacgatgaccttgagcaaatgcaattctcacacattgttggggaaaatgacaaatggtacaatcactttgaaaaacagtttggcagtttctcatgaggttaaacattcacttagcatccagtgcagcaatacaataccactctgaggtatttacccaaaagaaatgaaaacctatgcttacacaaaaacctgtattcaaatatttatagctgttttattcatcattgccaaaaactggaagcaaacaaatgaccagtcgctggttaatggataaacaaactgaggcctatccatacaataggatactactcagcaccagaaagaaaaaattactgatatacgtaacaatcacctgatcagataaatctgataattctgctatgtgaaataaacacactcaaaggctacgtatcataagattccacttacatgacattctataaagggaatgaaaacaggaaagagagtactggttgtgaggggcttggggtagggatcagggttgactacagaagggcatgagggaacttttttttttttttgagatggagtcttgctgtgttgcccaggctggagtgcagtggagtgatcttggctcactgcaacctccacctcctgggttcaagcaattctcctgcctcagcctcccgagtaactaggattaaaggcgcctgccaccatgcccggctaagttttatatatatttttttagtagagataaggtttcaccatgttggccaggctggtctcaaactcctgacttcaaatgatccgcccgcctcggcctccccaaatgctgagattacagacgtgagctactgcgccccgccgtgagggaactttttttttagatggagtctgtctctgtcacccagggtgaagtgtggcggcacaatctcagctcactgcaacctccgcctcccaggttcaaatgattatcctgcctcagcctcccgagtagctgggattacaggcgtgcatcaccatgcccaattttttgtatttttagtagagacagggtttcaccatgatggccaagctggtcttgaactcctgacctcttgatccgcctgcctcagcctcccaaagtgctgggattacaggttcgagccactgtgcaccaccatgagggaacttttaaggggaatggaaatgtctatatcttggtagtggtggcagttccatgactgtatttgtttcttaaactcatagaactgcatactaaagaggatgaaatttactgtatgaaaattgtacctcaataaacctgactttttaaaaagctggccagatgcggtggctcacacttataatcccagtactttgggaggccgaggcaggaggatcacttgagctcaggagttcgagaccagcctggccaacatggcaaagccccatctctaccaaaaatacaaaaactaccctagtgtggtggtgcacacctgtggtctcaactactcaggaggctgaggtgggaggatcactgaagcccgcaaagtgaagcctgcagtgagccaagatcatgccactgcactccagcctgggtgacagagtgagacctgtccgcccctgccccctcaacaaaagaacaaagccaaaggaaatttgccaccatcaatattaaggttctttccaaaaattcattctaaaaccttaatggaaattcccagaatccagttccaaacacattctgagcggtgaggacaactttggaattgaaaaagagctctcaaagtggtacactttgaagggacagtactgggatgggggtgggggtaagtaaaacaaaagttgacattaatctaaaactttaaagagttgtggctttattttacacatcatgaaacaaaccagaggatgtcaagacacttcattttcaagctctcttctgtgaggcaaagagttggagaccagagttccaagtccctcttctgaaagttatcagctttgaaaactgaatttgagcaactcatttatcctctttgggccccattttcttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccccccattttcttcctgtggtaaatgagggcagtagactgggtaactccaaggtttcattctctgaactcattcattcaatgttctttctctataaattctcataattttaactactgtctatctgctggtgaggctgggtgcagtggctcacgcctgtaatctcagcactctgggaagccaaggtgggagggtcgcttgaactcaggcattcaagaccagcctgggtaacacagcaagacctcatctctataaaaataaaaaataggccaggcgtggccaggattacgcctgtaatcccagcactttgggaggccaaggcaggtggatcgcttgacgtcaggagttcgaaaccagcctggccaacatggtgaaaccccgtctttactaaaaatacaaaaattagccaggcgtggtggacagcacctgcagtcccagctactcgggaggctgaggcaggagaatcacttgaacccaggaggcagaggttgcagtgagccaagatcgcgccattgcactccagcctgggtgatggagcgagactccgtctcaaaaaataaaaataaaataaaaaagaatatatctgctcacaagttcctaattcataccttctgtgtctttaactatatatctgggtaacccccgccaggaaccttaaactcaaatggaaatttaactcacctttctcctccctaagccccacctcttcctatctccctctctcctccctctccccaaatcctcctcagtggcaaacctccagtgtcacaggatccagaaacccagaagccatttttgactcctccctctccctcatttcccattacccaggcaattgccaacccttatattttgactgttttttttagatagggtctcgctctaccacccaggctggagtgcagtggcaggatcatagctcactgcagcctcaatctcctgggctcaagtgatcctcctgcctcagcctccagagtggctgggcttacaggtgcacaccaccatgctcagctaacattttgactacttgataattctcaaagcaattctcagctccacatctctatcaccattaccctaattcaagccctcgttatcatctctggcctggactactgccaacaacttccctgccatagttctgttggccccatattcatcctctacacagacaccagaagtgtctttctaaaatacaaatcagagcatgtcacacctctgcttaaagccctccagaaccaacagcaatgattaccctttcttgagtcacaaatccctttgaaaatctgaaggtcgcaattaactcactttccaaaaaaaaaaaaagcatgctcacacacacatacacacacagagggaagatataacaacccccctgaaatccatccagagactacttttttttttttttttttttttttgagacagggtctcgctctgtcacccaggctggagtacagtggtgtgatctcggctcgctgcaacctccacatcccagactcaagcaattctcttgcctcagcctccctagtagctgggactacagacatgtgccagcacatctggctaactttttttgtatttttttatagaaatggggttttgccatgttgcccaggctggcctcaaactcctgggctcaagtgatccactcaccttggcctcccaaactgctgggattacaggtgttagccaccacacctggcctctttttttttttttaattagagatgggatcttgctatgttggccaggctggacttgaactcttgggctcaagcgagcctcccatgtagctgggactacaggcatggatccccacgtcagaccaaccatccagagactcttggtctacatgataaagtccaaccacttaacataacacatcaccaaagtatcccttacacattacatgttatgctcaggcaaccctgaattttctttttttaaaacctattcattagaaatcttcaaataatttgctgaattacaactttataaatgatagttactctaatcctggcgaccttatacattgtgtcacaacaactcggaatgaaatcatagttttccatctgtggaaaactccatttgctgtcctatttacctggaacatcctcaccctcttctttctctgacaagtcttacttctcttccagtatgactctggcatcaccttctcttggaagctttgctttaccttctcagtctgggttagaggttcagccactgtgcatatttctaaaactccactgcaattttctttctatatgtctgaccttctcccaccaacacccctaacattatactttgagggcaggaaacagtactgtgtagcatttaacacaggtcctagacatagacggcgctcaaaaacatctgtggaaggaggaagggtgggaaggagggagggaattaaaaaagaagggagggaaggagagaggcaggcaaatcttgtgactccaaatcctaatgtcttcagacttcatatatttttctttctgcaaaacacgtgcctaacaaggagtgcagctgtgctttacaagtattatctgatgaaggagtaagatactgcttatctcctttttacaaatgaggaacttaagtgcagagacattctctgccacagaaaacagcacgtttcttaaatgtgtttttagtcctaatatatctatgggcattacctccaagaacataatatcaaacattaggaaaagcataactcaaataacaaaatattccaagaccgaattcagtgactatcttatacactgtcttatacactaaagcctgctttagcatagactgtaaataattgtatggaagattcttggctaccaattgaccttataatgacagcagtaaaaaaatgtatatttttttactgtttaacctaaaaaaaaatggttcctcttttaggatcttatgcaatttctgtggccacaaaagaacactgtgtgcactttatatatttttttcctttcttttttctttttttagagatagcatcttgctctgtcacccacgttagagtacagtggcatggtcgtagctcactgcagcctcaaattcctgggctcaagctatcctcttatctcagcctcctgagtagctgaggctacaggcatgtgcctctacgctcagttaatttttaaatttttttgtagagactgggtctcgctgtattgcccaggctggtcttgaactcctgggctccagtgatcctcccacctaggcctcccaaagtgctggggatacaggtgtgaaccactgcactctgcctacttttatattattttaaaatttccttcacatgtgttggtactcatagaacagaattgcgtgagtcaaattagtgaccagtagtgacttctacaaaagctttcattacttcaaaaccactgataatgcagccatagaaagtatcaaccaagaataactaaatcacttaggtataaaactcgcagattccccaaagacagaaaaatcttcgaccctataactgtgactacctgagaagtggatacagcttttctggaagtcatagaaaaacatcttaagatcacaaagtctcctgataaaaaccaaaaagcttgcaggtgagcagtctgggtatataagaaaaaacaaaaaaccaaaaagctctactcagacaaaccacctactgtgaagttcacaagaatttgctatttcagagggaataaaggatacagcacagtgtcaagaccaagctaagccaatttccagcccttcagtttcccctctcttttttttttgagaaggagtctcgctctgtctccaggctggaatgcagtggcatgatctcggctcactgcaacctccacctcccaggttcaagtgattctcctgcctcagcctcctgagtagctggaactacaggcgtgcgccaccacacccagctaatttttgtatttttagtagagacagggttttatcacgttggccaggatggtcttgatctcttgacctcgtgatctgcccaccttggcctcccaaagtgctgggattacaggcatgagccaccttgcccggccccctctccaaattcttactcctgttatctacaagatccctttcaaagttaagaaaaatgataaaatacaatactcttgagattatttgctttttgtcaaatcaaaatctttgcccaaagattaaggcaatgtctggtaggtatgtggggaggcagcaagactgtaatcttgaacttgaatgataggggttagttactgtcaccctgcttgccgagtgtcatgcaaggatgagatgagaggaacacaaagaaccgtggatatgttgttgaagccgaggcattttgtgggcttctcaaatgagcaggaataccctcccagagtaaaatgtggtcaatacctttgcttaaagaatgatttggaaaagtgcttcttcccaagacctaaaagatgaccatatttagctttggaacagtttgttccttttactttaaatggaagagcattttctttcccataagcattaaatacagtactatatctccatttttaagtagttttaggctgggcgcactggctcacatgtgtaatcccagcactttgggaggctgaggcaggaggattgcttgagctcaggagttcaagaccagcctagacaatacagtgaaaccccatctctacaaaaaatacaaaaattagtcgggtgtcatggtgcatgcctgtagtcccacaactcaggaggttgaggtaggaggcttgcttgagtccgtaaggcagaggttgcagtgagccgagactgtaccactgcactccagcctgggtgatagggccaggtcttgtctcaaaaaaaatttaaaaagtagttttagggggcaaaaaactgggatcccttttctgaccaggctaaagcttccttcattgacgcatgcaatttttttttttttgagatggagtcgcactctgtcaccaagggtatagtgcaatggcgcaatcttggctcactgcaacctctgcctcccaggctcaagtgattctcctgcttcagcctcccaagtagctgggattacaagcgtctgccaccacgcctggctaacttttgtatttttagtagaaacagggtttcaccatgttggccaggctggtctcaaactcctcaagtgatctgcctgcctcagcctcccaaagtgctgggattacaggcatgagccatcgcacccagccagactcatgcaatttttaatgtatatttagtaatcataataactgtgttggaaggtttaataaaagaaagcatactgaaatacttttcctggggaaaggcaatgaccacacatttcttaaaaaaataaaattggttatttatacacaagttcccctacctccatctctttaatctttgtactgcttgtgcctagcaagaaataggtattctgtcaggcacggtagctcacacctgtaatcctagcactttgggaggatcacttgagcccaggagttcaagattagcctgagcaatacagtgagatctcatctctaccaaaaaatttttcaaaaaattaatgaggtgtggtggcacgtgcctgtggtcccaggtactcaggaggctgaggtaggaggcttgcttgagcccaggaggttgaagctgcagtgagctgtgatcacaccactgcactccagcctcaatgacaaagggagactgtcgaaagaaagaaagaaaaagaaagaaagaaaggaaggaaggaaagaaggaaggaaggaaaaaaatgggtattcaattaaagtttgttaaataaaaacagattttttcttcctaatgcatgttttctcttcatttttcttatctgaagtcttcccttggaatataagtaagtcttcctccttcccatttaatatctcattgcctgattgtttttcagtttaaacaacaggagaatccaataacaaatatttaccaatagctaagagttactgaaagtgccttcttagttataaaaagttaatccatttttaatgtaaggcaagaagttcacaattaaacctaagaggataatttactatagatagacgtgaagtacctaaaaagaaatgaatatccaatctacacctatataatggcaaaaattagaactagagtttcagagtcagaggggacattaatgtcaggtcggcaggtctgggctcacatccaatccaaaccaagctttgctgagtgtcccttccctccactttctcctgaatcattcccccttgggctaggagtttccaagaaggcaaataaactaagataagcaacaagagcaaagaatggcaactcaaatgtgcagttcaaggctttgaatacgaattttttttaacactaatgaaaaaggtagtatcatagctcttaaaatattgaaatacttctctctgtccagtatcagcagataatgcagaaaagcccattgggaacatgttcctctccttcaaatgccacttagaaagcttcatcattattcataaatgatgaatagaagtctgggcatggccgggtgtggtggctcatacctgtaatcccagcgctttgggaggctgaggtgggtggatcgcctaaggtcaggagttcgagaccagcctggccaacatggtgaaacctcgtctctactaaaaatacaaaaattagctgggtgcggtggcacgcacctgtaatcccagctactcaggaggctgaggcaggagaatcgcttgaacctgggaggcggaggttgcagtgagctgagatcgcgccactacactccagcctgggtgacagagcaagactccgtctcaaaaaaaaaaaaaaaaaaaaaagtagtgtttacaatataagggaaattgggatcccatgttctaattcaaagaatttaaggctattaaccattttaaagttctcatgtttaagcttctcactttatccttctttattcaagaaaatccataatacaaagtattggcaaagatgtgaggaactggaactgccatacactgctagtgggagtggaaattggtgtaaccactgtggaaaaccgtttgacggtatctaccaaacctgaacatatcccttccctatgatccaggaattctacttgtgggcataatcctttatactggtgtttatgtccaccatatataaaacaatgttcacagcagtgctatgcataattacacaaaattggaacaacttccatgtgcttcgtgaacataatggataaaataaattataagatctattcataccacggaatggtaccagcaattaaaaaaaaaaacactgctacagagaacaaggttgaatcttattattataatgttgagtaaaagaaggtggacataaaagagcacacgatgatggtttggtttacatgaagttcaaacataggcaaaagcaatccatggcatcagaagtcagaatagtggctacctggggagggggtactgacagagagggtggagctagaattgctctatatctcagtctgatcgtggttatttgggcacgtacatatgtgaaaactaatgaaattgtactcttaagatgtgtgcatatttactgtgtgccaattatacttcatttagaaatatctggagagagagacatagaaatttctgaattctttcctaaatagaaaagaattccatgcagcttaaatatcgttgcaagtattgatgcttatacctttagaaagcccattatgcttctgaaaaatgcacttactacttaatatcatacataatagaaagctaacattttgtattaacggaatctggaaaacatattgtactacacatttgaaattacagatttactaactagtaaagataactatttaagaactaaaatgtctttgtttttcaactcttttcccccgatttccattttttactttttatatttcagaattatttgtaacaaaagctattggatataattcctgcacttctatattgcaagcattttctctatttaccacagagacttcaagtcctagcatttcagagctgaaggggactcggacggactccctcactgcacagatgaggacgcggaggccgggggaggtgagtgtcagtcccaaggttgcagacctaggacagggaccggagctgccgggcacccagaactctgtcgccttcaacccaaattcgattcagtcctctcatctttccaaatagaaagctgacgcgaaccgatgggaagattttttttttcaataacaactatgctacccagcagattctttggggacagtcctcggagtccttgaaaacccctttggggtttatgccaggataagaagagactagaagaaagggacagctagtattttaatatgtaaatctgtttgcataatatttcctaggtaaactattcgttgatccaaccaaaattcggcggggctggggggtatcgttattgaggatgactcgctctaggggagaacgcggacgcattttcccatcagagttccctccataaatcaaaacctcaaaagaagagttaaagacgacacccaggtgtctacagtatccaagggccgggccaggagaggtccttggccacctggcgccgagttcgcggccgcagactcccacggacggcccagcacccgagcgcgcgggccgagctgccccagacccggcgcagcgcctcggcgaggccgtctgcgaagtccgggccgccactcgggaccgcggcccgagccagaggagagacttcggagaagagggaagaggacgcggggtgggaaacgccggggccgcaggcaagtagtgggcgagtccggagggcgcgaaagaggggaggggcgcgggaggcaatggaaggagcgagcgcggggaggagcgaggcggctgggccggaggaggcgcgcgcccgggtccacactgcggggtgggggctgagggaccgcgaggggctgcgagcgagcgagcggggccttaccgagcagcggcagctggccgccgtcgcgcgccaacgccggcatggcctccggagcccggggtccccaggccgcgccggcccagccctgcgatgccgcctggagcggcgcgcctcgcgctgcaggtggctctcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccgccagcgcacaggcgagcattccattaagaaccattccattcttaattgtggactgatttcctttgtctctgcctccatctcctaggatgctcaggacccagtcagcggcgggatcaagaaaaacaggcagggtttcaatgtcaaccaaggcaattagggaggttaacaaacagccttcaaaacaaaacacacagaaaatacatcccagaggatgttgcgaatcatccgctcaatagttcttgttcttcatcgcataatttttcgagttgaaaattattattattttctttgcaataagttgaggattggaaagctctggatgccagttctggttcttcccttacttaactagccgtttgacctccacaaacctctgtttactcatcgtaaaggaaagggatggaccaaatggttcataatgtctctcccaattctaggaattccacgctcttaattattttaattattttctaataaagcatgaaaattgactgtttactcttggccatacagttcttttccttagatgttgtctacagtacaataattctttcccctagggtatggcagaaactttagaagtgtctaccatggtgcagccactatggaaaacactatagaggtttctcaaaaaattaaaaaaaatacggtccaacaattccatttctggccatgtagccaaaagaattgaaagcagggtcttgaagagatgtctgtacacccgtgttgaaagcagcattattcacagtagtcaaaaggcagaagtaacccatgtccacaacagatgaatgataaacaaaaatgcagtatatacatacgactgagtatttttcagctttaaagaggagggaaattctgatacagctaaaatatggatgaatcttgacattatgctaagtgaaataagctagtcccaaaaaatacaatactgtatcccattacaaattcataaagacagaaagttaaatggtggttaccatgggctgggggcagggggaaatggggagccagtgtttaatggatacagagtttcagttttgcaagatgagcagagttctggagactggttgcacaacaatgtgaatgtacttaacgctactaaactgtacacttaaaaatggctaaggctgggtgcggtggctcatgcctgtaatcctagcactttgggaggccgaggtgggcagatcacctgaggtcagcagttcgagaccagcctagccaacatggtgaaaccccatctctacaaaaatgcaacaattagccaggcgtagtggcgcatgcctgtaatcccagctacctgggaggttgaggcaggagaatcactggaacccgggaggcagaggctgcagtgagctgagatcacaccactgcactccagcctgggtgacagagtgagactctgtctcaaaaacaaaaacaaaaacaaaaagttaagatggtaaattttatgtatgtgtattttacctcaattttaaattttttaagtttttgtgtagctgctgggggtttaaaaatttttttaaagagtgttgtgtctaccttaggtcagaaacagaagtgaaggaagatggcctgaaataagtgaaacatgaggagataaagcaatgaaacaggctggttatggggagaaaagcgagcttccaatggccaagacctaacacactaccttctatttaaagctcaattactgtcttaaaggaaactgattggctgggcgctgtggctcatgcctgcaatcccagcgctttgggaggccaaagcgggtggatcatttgaggtcaggagttggagaccagcctgaccaacatggtgaaaccccatctctaacaaaaatacaaaaattagctgggcatggtggcactgtagtcgtagctacttgggaggctgaggcaggggaattgcttgaacccaggaagcagatgttgcagtgaactgagatcatgccactgcactccagcctgggcaacagagcaagacttggtcttcgccgggcgtagtggctcatgcctgtaatcccagcactttgggaagctaaggcaggtggatcacgaggtcaggagttcaagaccagcctggcaaagatggtgaaacctgtctctactaaaaatacaaaaaattagccaggcgtggtggcatacgcctgtaatcccagctactcaggaggctgaggcagagaattgcttaaacttggggagcggaggttgcagtgagccaagatcgcgccactacactccagcctgggcgacagagggagattccgtctcaaaaaaataaataaataaaatgaaaaactaaaaaaaaaatgaaactgattattacaaatttgcagaacatcagcttgagtgcagcagtattcaggatacaaaatcataaagatactgctgctttgtccaagaatcttggacacaaggcagagatcttcatgaaaaagggggttggtgagagaggagaagttaggaatggtttctttttttgagacagagtcttgctctgtcgcccaggctagagtgcagtggcacgatctaggctcactacaacctccgcctcccgggttcaagcgattctccagcctcagccacctgagtagctgggattacaggcacccgccactgcgcccagctaattttgtatttttagtagagaagggtttcaccatcttggccaggctggtctcaaactcctgacctcgtgatccaccctccttggactcccaaagtgctgggattacaggtgtgagtcaccgcggccagccaggaatggtttctaggaacacttgattttccgtggaaattggtggaaaaaataattctagaaggagcaaatcttatagactgaaatattttggagtatgaggtataggctaacagaaggtgaagtaatgcccatgtttttctgtgatgtgccaagagtcatatctaatatgagaactaatttcttcctcacagcaacacttaaggaaagtagcctgaaattgtctagagtcctggattacacgcccaggtatgcatgcccaagtatgaaattttggtgtcagagttcatgataggaattctgtaataaagaaactcttaaagggtcaaaagcaactagaagaaatgagctgaaacgggaaatcggaaaagagaagagtaagtttgtttctgggttgaatggagtgtctagtgctaactctacgaaaggatgtattttatctagattcttagcaccatgatgcttagccatgagtaagtggtcatctatcttaccagcatcttgataccatgtttccaccccttaagtcacacaaatatctcctctccctttcctctctctctccaaaaattgtgacatagtttcgtagcagctcacaggtgaaatactttcatgtcatttttaacttacaaagccttatgttttcctgaaaatcagggacaaacaaaaggaatatttgaatagggttcatgtgagttcagttgagatatcaactttatagtataattttacacatcttttattaataggggctttgaactcaccaattggcaaaatctgacaatacaaagtgttgacaagaattcagagcaatggagaacacccacacactgttggtggacatcccaatgggtgtgagcactttgaaaaataatttggcatatcttactaaagttgaacatatcctccagccagcagtttcacccccagatataaacctcaaagaaacacatatgtgccaagagacaagtataagaatgttcatagcattattgtttataatatcaaaaaattgggaacaatctaaatgcccaccaacaaaaggataaattgcagtacagtcataataaaatacctatatattaaataacagtgtaaatgaatgagctacagttacctgacacaccatgaatgaatctcaaaaacataatgttgagggggaaaagcaagtcatggaataatagacataaaggcggaagcaaacaatattctccttaggaatacattcataggggtataaggaaagtaaaggaataattaccacaaaagtcaggattgtggttacgtctggtatggggtgggaagaggaggtttaattagagaagacaaactggggatttctgaggtgctaacataccctattgttgttttgcgatagggtcttgctacactgcccaagctggagtgtaatggctattcacaggcacgaccatagctcactgcagccttgaactcctgggctcaagcctctgggtagctgggactacaggtgtggaccaccatgtccaaccacaccctatttttttttaacctctgtggtgggtgctggatgttcattttattgttattctttaaactatgtaattatttttacacactgctgtgaatatgatgtatttcacaacaaaagaaaattaaaggccgggtgcggtggctcatgcctgtaatcacagtattttgggaggccgaggcgggcggatcacaggtcaggagtttgagaccagcctggccaacatggtgaaaccccgtctctactaaaagtacaaaaattagccgggcacagtggcacgcacctgtaatcccagctacttgggagggaggctgaggcaggagaatcacttgaacccaggaggcggaggttgcagtgagccgagatggtgccattgcactctagcctgggcgacagagcaagactccaactcaaaaaaaaaaaggaaaattaaagaagtttgaggccagtcacagtggctcacacctataatcccagcacttcgggaggctgagataagaggatcactgagcctagaagttacagaccaccctgggcaataaaatgagaccccacttctagaaaaaaaaaattaaaattagccgggtatgtggctcacacctgtagtcccagctattcaggaggctgagtcaggaggattgtttgaacccagaaacttgaggctgcagtgagctgcgattgtgtcactgcacttcagcttgagcaacagagcaagatcttgtctctaaaaaataataattaaaaataaataaataagtttgacacattttcacctacaagtattcttatacaaacaaatgatatttgaatctgattaagattccagggcctggtggcgcacacctgaagatcccagatccaactaccaatttataggaaatacatgggatagtggaatatgggacaacacagggacataattttaaaattccaaaggccaggtgcagtggctcacacctgtaatcccagcactttgggaggctgaggggggcggatcacttgaggtcaggagttcaagaccagcctggccaacatagtgaaaccctgtctctactaaaaatacaaaaataagctgggcatggtggcggccgcctgtaatcccagctactcaggaggctgagacaggaggatcgcttgaacccagaaggtggaggttgcagtgagcccagatggtaccattgcactccagcctgggtgacacagcaagactccatctcaaaaaaatataaataaataaataaataaataataaataaaataaaattccagaacctaggaaactgtatggaacaaatatcttggtttcttcaacgaaaatttgtaagaaaataaaaaaagagatggagcctataaattaaaagaaacctaagatatattaaggacattacaatatcaagcaattgtaatgtgcaatgtaaagatgttatttggatgctgattcaagtaacccgaaaaatatacataaaataattgggaaaatgtgatcactggttttaattttgatattattttataaaaaattatatgtgtgtgggaggctgaggtaggagaattgcttgaaccccaggaggcggaggttgcagtgagccgagattgcgccactgcactccagcctgggggacagagagagactctgtctccattaaaaaaaaaaaaaattatgtgtgatgatagcattgttatatattttaaaaatcattcctatctttgcagaggtacacatgaaatagttacagaaaaaatgatatgaaatgggaaggttgagggggaataaggagtgacagttaatgggaacagggtttctttttttcggatgatgaaactattgtaaaattagattatggtgatggttgctcaactctgtaaatacactaaaaaccactgaattgtaggctaaataggtgaactatagacatgtaaattggatctcagtgaagctgtaaaaaatgacataaagccagagattttcttcaaaatcatctgatgtggagggtttgagtggagcaatcaaaattaaccatgtgtcaccagtagttgcacctcagccacagtcatataagttcattatactttttattagacattttctataataaaaggttttgaataaaaaagatttgaagaaaaggccgagccgttgcgtacctaggatgccatgtggaagctgaagctgcacctcccgcgtgacccctctagccagctgggcccctcagatgagagttgcatccaggccagcactagccgctcagccaccagcagcggcacccccatctgcagttggctctcctgctgctgtgccccgtctgatggcccaaatggcaaccactgcagctggcgcggctgtgggctctgccgtggggcacacactgggtcacgccattactggggggtttagtggaggaagtaatgctgagcctgcgaggcctgacatcacttaccaggagcctcagggaacccagctggcacagcagcagcagccttgcttctatgagatcgaacagtttctggagtgtgcccagaaccatggtgacatcaagctctgtgagggtttcaatgaggtgctgaaacagtgccgactggcaaaacgattggcctgatcaagaagttcaacctggagaaatggaaaatcagctctataaccaagttaatttagtataaaaatcaaattgatagtgaaggtataaagtgtaaccatcagttaaacctcttgtgtcattcctagcttccttgcttctgaattgaaatggaagggggtgttcctactctgtagaatttggggctgggcaaatgtttgtgtggcctccttaaaagagctgttatgattttattctttgtgagttaattagaataaagtcattttcttccaagggaaaaaaaaagatttgaaatattggacaagttaacttatcctgaatgtgtggaagatgactacccctgcttagaactcatgagctgctctttactgtgtttttattaacccatctaaatgggatgaacaataacaggaccctggaatctgtttccattatgcaattggtggcacacaggtaaactgcaaaattccaactgcagaatttcataattgatagttcttcctttatgtctaagatgatttcaaaataatcatctccttagaattattcgcaacagataatgtattagtttgctggagctgccataacaaagtaccacagacacagttctggaggccagaagtccaagatcaaggtgttggcagggttggttctaagggctgtcatggagaatctgttccaagccttgtactggcttctggtggtttgcaggcaatatttggtgctccttggcttctgctacatcaccccgacctctgccttcatgttcacgtggcagtctccctgtgtgtgtgtctgtctagcgctgcatttgaatttccccttttcataaggataccggtcatattggattaggacccacccaatgacctcagtgtaacttgattacctctgtaaaaagcctatctccaaataaggtcacattctgaggaatatggggttaggacctcaaaaatacgttttttaggaccacaaaaaaattgtgtcctgttaagggacacaattcagcccttaacggatagatttcaaaatcaatagaaattaattcatttgcttcacctatagattgcttgttaattgatatattaagtagatttcaatttgatattttacttttacaaaaaatattgagcatgggtaacttttagaagtcaacacaaaaatgggagctgttgaaaattttgctttcaaagagtttaaggttaaaaaagggtacaaactacatgacatgacagtcattaaattttcagaaattatgtatatgcctactcaaataactagaagataatacactaaaatgcaaactgattatctctgactcatggccttattagtgagatggaactgatttctccatcagaaatctaaggctcagagctgttaggtgacctacctaaagtctcacagccagtaagaggctgaatgtgattagaattcaaattggctcatatccaaaacccctgctttcagccattatggcttagaataataattgccaccatttgagttcctaaaatgtgccaaacattataccaatcactttacaatctttgcttcacttaatactaataacaatcccataggttaggtatttttcccattccaaagaagtctaatagcagcctaaactttgaagcaggagagatggatgatccagaaagccaaaagagggagttcatggaaagaagacaagttacaaagatggaggtatctgtggtaaggcgagttggcccattttacactgtcaaaaataactaaggacataaggggtttgaacaaagtaattaacaaggaaagagtgaacacatttatgtagaatttatatcctacaagcagacaaaacatcttctttttggacttacatggcattttataaatatagttgtgtgtcacttaataggacaggttctgagaaatggattgctaggcaatttcattgttgcataaacatcagagtgtacttacacaaacctagatattagcctactgcatacccaggctatgtggtatagcctgttgcttctaggctacaaacttatatggcatgtattatactgaatactgtaggcagttgtaacacaatagtaagtatttgtatatctgaacatattgaaatatagaaaaagtacagtagaaaaccagaactataatcttttggatcattgtccatcttgaccaaaatgttgttatgcagcacatgactgtactacactctctgatcacactaggctttttccaaatatgctttttcttcccttgagctggcacatggatgtcacagtaatcccattttgacaatacgtacatgaacaacagcctagggtatggtggaacaacaatatagaaggcattagatttgcatgagcaactccaaaacctgtactacctacatccctctagactgctgcttaagagaaataaacttcggtctcatttaatccatggtgcttgggggctgtctgtaacaatagcttactttgtaccctgtttgcatagccaccactcctccacataaacccaagttagagtcacagtgaaccagaactccaaattcattatgttcttcttgtttccatgtcttgatacctgtgttggtatctgcaatgacccatgcccctttctcactatttcccttgccccttccagtctatgtgaccaactctgattcaccttctagattcattcctgactactctatcgctatccccccagccacatgtgactcaggtacatcctcttgtttctctcctctgtctgtcccactgtactacagttcttagcctctatgtttgtccaactgttgcctgaacctcatcccccaactgttactcacacttgcattcctagaccttaacacaacgactagtacccagcatgctctcataaatcaatgaatattcattgcatgactggtgaatttattgacgagtttcttcttttaattttatcttatttattttatttttgttttgttgttgttgttggtttttccaccagaggatattgacaagtttctaaaaaaaaattttgtttttttgagatagggtctcgcattatccaacatgccgaagtggagaggtatgatcatagctcactgcagccttgaactcccgggctcaagcgatcctcctgcctcagcctcctgagtagctgggatgacaaacccacaccaccacacctggcatatttatttatttatttttatttttatttttttgagacagaatttcactcttattgcccaggctggaatgcaatggcatgatctcggttaatggcaacctctacctcccggattcaagtgattcttctgcctcagcctccctagtagctgggactaaaggcatgcaccaccacacccggctaattttgtatttttagtagagacagggtttctccatcttggtcaggctagtctcgaactcctgacctcaggtgatcctcccacataggcctcccaaagtgctgggattacaggcgtgagccactgcgcctggcccctatttatttatgtgttttgtagagatgaagtctcactgtgttgtccaggctgatctcaaactcccagcctcaagtggtcctcccaccttgacctcccaaagtgcagagattacaggcatgagccactgtgcttgaccaaaaaaaaaaaaaaaaaaaaaaaactgtttaatatggaaattttcaaacatacacaaaagttgaaagaataatataatgatacatgtatccatcactctgtttcaacaatgaccatcattttgtcattcctgagaatgagtagagctccagagtgcagtttttggagacaacgttttaactaaaaaggactacttcaattgggaatttttttttttgagacggagtcttgctctgttgcccaggctggagtgcagtggtgcgatctcggctcacttcaagctctgtctcctgggttcacgccattctgctggcttagcctcctgagcagctgggaccacaggcgcccaccaccatgcctggctaattttttgtatttttgtagagacggggtttcaccacgctagccaggatgatcttgatctcctgacctcatgatccgcgcccctcagcctcccaaagtgctgggattacaggcgtgagccaccgcgcccagcctcaattgggatatttttaatcactgtggcaatctggtaaggaggtattttcaggatttttattttaggggataagggtcttcaaatcaggatctgcactttaaaaaaacagtgtaggccgggcgtggtgactcacacctgtaatcccagcactttgggaggccgaggcaggcggatcacaaggtcaggagttcaagaccagcctggccaaaatggtgagaccccatctctattaaaaatacaaaaattagctggatgtggtggcatgtgcctgtaacctcagctacttggagggctgagacaggagaatcacttgaacccgggaggcagaggttgcagtgagccgagatagcgccattgtactccagcatggcaacagagcgagactccgtctctaaataaataagtaaaaaataacagtgtagaggcaataagagaaatagttattctttattcccaaaggtatataatataatattgcttgacagtcacataaacaaatatttgcaccaaagtgttacagaggttttgataaaagcatgtgccaggcatactagggtcacagtgaaaaatgtgctccataaaacattcccttcactatggcccttagaaaccttggtttaacccaaggaaactgcttcctttgtagctctttcaaatgctacagaggaagcagttggggaaaattcttgtttccccctgttccatatatgatgaagcctggaatattggcattcttttagttctccattgctacttacagatcattacctattttttttctattaaaaataatactcttggcggggcatggtggctcatgcctgtaatctttgggaagtccaggcggacagatcacttgaggtcaggagttcaagactagcctggccaacatagtgaaaccccctctctattacaaatacaaaaatgggccaggcgtggtggctcatgcctgtaatcccagcactttgggaggccgaggtgggcagatcacctgaggttgggagtttgagaccaccctgaccaacatagtcaaaccctgtctctactaaaaatacaaaattagccagatgtggtggcaggcacctgtaatcccagctacttgggaggctgaggcaggagaatcacttgaacccgggagacggaggttgcagtgagctgagatcacacgattgcactccagcctggccgacaacagtgaaactacgtctcaaaaaaaaaaaaaaaaaaggtggtgcacatctgtagtcccagctacttgggaggctgaggcatgagagtcgcttgaacctgggagcccgaggctgcagtaagccaagatggcgccactgcactccagcctgggtgacagagtgagactctgtctcaaaaaaaaaaaaaaaaaagaaaagggagtattctttttctagcataagtgtacatgttaaatgcaaaaaaggaaaaaagttggaaagtatccatacgcacactcacactacctgtaccaactgataaccatttacacttcgatgccagtctatccagttttttctctatgagtatatttatacatagatctaaacatatattttatgaataggattatcatacacatgctccttctttgcttacttaaaaaaaaaattgggctgggcgcggtgactcacgcctgtaatcccagcactttgggaggctgaggcaggcggatcacgaggtcaggagatcgagaccatcctggctagcacagtgaaaccccgtcactactaaatatacaaaaaaaaaaaaaaaaaaaattagccgggtatggtggcggacgcctgtagtcccagctactccagaggctgaggcaggagaatggcgtgaacccgggaggcagagcttgcagtgagccaagattgcgccactgcactccagcctggggaacagagcgagattctgtctcaaaaaaaataaataaataaagtaaaataaaataaaatcggccgggcgtgatggcttatgcctgtaatcccagcactttgggaggccgaggtggacagatcacttgaggtgaggagttcgagaccagcctggctaacatggtgaaaccctgtctctacaaaaaatacaaaaattagccgggcgtgctagcacgtgcctgtaatcccagctacttgggaggctgaggcaggagaattgcttgaacctgggaggcagaggttgcagtgagctgagatcgtgccattgtgctccagcctggccaaaaaatcaagacttcgtctcaaaaaaaaaaaaaaatcaaatattgtccatgttgattatgccacaacattactgttaagttactcattccatgatatggatgaatcataatttatggaaccaatacatgcttttggacattttatagatatgtttgattttgttttttgttttgttttttgcgacagagttgttgcccagactggagtgcaatggcgcgatctcagctcaccacaacctctgcctcccgggttcaagagattctcctgtctcagcctcccaagtagctgggactacgggcatgtgccaccacatgtggctaattttgtatttttagtacagacggggtttctccatgtcggtaaggctggtctcgaactcccgacctctggtgatccacccgcctaggcctcccaaagtgctgggattgcaggcacaagctaccgtgcctggcattttgtttttgagacggggtctcactctgtaacccaggctggagtgcagtggcacgatatcggctcactgcaacctccacctcccaggttcaagcaattctcctgcctcagcctcccgagcagctgggactataggcacatgccaccacgcctggctaatttttgtatttttagtagagacggggtttcaccatattggccaggctagtctcaaactcctgacctcatgatccacctgtgttggcctcccaaagtgctgggattacaggtgtgagccacggtgcctggccaggtatctttgttttaatattcagttattatggctacacattttatttatttaattgttttttattttttatttttacagattgaggctcgctgtgttgcccaggcttgttcaaacacctgggcttaaggaatcctcgcacctcagcctcccaaagtactgagattacaggtgagagccactgcacctggccaaggctgcacattttagaacttagttttttgaagcttttgagctcaacttacaagtattgtcatttaatttataaatcgaatatagttttgaaatttaaaatactcatcttacttgtactttgataatcatcttataaatttaaattattgaattgtattaaatcttcctaaacattcaacacctttatgaaattctcttagaagtttcaaactagtcacacatttagtaaatttattcctctgtagtgcttcaaacacttaataaaagtctaattaaactttctcagcatttaagaagcatttacatgcataataatacaaaatttgcagatatactaattagattccttcacatgtttacacagtcattacaaacttaattagctacatttttctaaggatttcacctaaaaacataaatctgtcagattctcttaaaacacatgaaacacctcaaatcatgaacaaaacacagaaactataacagattgcaaacttattacacctgcacaaaaatgttaagattgtaatttgcatcaattttttttataatttaaaaacttcccagagttgcaagtttactcacctgcctaagaggagctcaggatggctgtgatttgtgcttatgattattggttgtagatctggcatcaggagttggaagctgggtgcacctttcaggataattcacacaggccagtctcttttggctagttcacatcacgtttttcaaaattaaaaaatctggcttctcatgtattcctcttagccactgctaccttttcttttttttttttttttttttttttttttgacagggtctcactccgtcgcccaggctggagtgcaatggtgcaatcttagctgactgcaacctctgcctcccaggctcaagagatcctcccacctcagcctcccaactaaatgggactacaggcatgcaccaccatgcctggctgttatttgtattttttgtagacactgggtcttgccatgttgcccaggctggtctggcactcctgagcacaagcactctctgcccacctctgcctcctcccaaagtgctgggattacaggtgtgagccgctgtgtctggccaccaccacctttttgaactgtaatctcttacacaacttttcacttcctgaactgagtggaaggaatgttgcactcccagctagttactctcattcatttgcacctctccactccagcacttttcatgatgacaaatacccgtccaatcgtctacccttaaagaacatagacacccttgctgccaacaactttgactacaatttatcagtccttttctattgttacaccttgaaatcttctacctttgaaatcttaaatttcaatacaccaatctaatagcaactcccaatcccctccctggtctgcatcttaattcaagtctaattaggtttgcatgattaaaaatctgctagaattagtctggaaggtgacttttaaaagaaggaaagggaataacatggcttgatagtgccaatataaagaatctattatcaattcgagtgattgctaggtgatggacctgtagggagagatcactagatgagttcaggtggtaaatagaaaactcctgttggggtgcagtgagagatgaaggtagtgaaatgaaaggatggggatcaattttatatgagggctttaatttgaaatgggaatttggtgatattctcagagcagcacaagttttcatgccatggaaaagcagcaggaaaaatgtaaaccttgccaataacacgggaaagtctccaagggtgcccagtgacttacttgcctataaacaaagccattcctgagcacttctggctatgaaatttcaaaatacatgttttagagaattttactgacacttttatgattttagaggataatttagatttcataaattttgtttccttccctttgcccctaaaaatcatgaacataatcctgaaaatctcagcattccaacaaacaataaccaaatgtcttcagtcagttaggattgctatgagtatatataccaacaacatttgaacatttctagatttatggttaacaaaaaagaatcatattaactaaagactttctctgcttgaatcggtttcaagtattcaagggattattaatggattttagttaaagttaaaatggttcacaactagcaacctttacgctgatcctaagaatttccacctcctgtcattcatgcttttgggtaatgccctcccctgagtgtaagagctaatgactcccttctgacacaaagaacatggcaaaattgacaggacatcattttcacagtttggttacaaaaaaaaaaaaactgtggcttccagcctgagcagcaaactcagaccttgtctctacaaaaaaaattttaaattagccagacatggtagtgtgagcccagctgctcgggaggctgaggcaggaggatctcttgagccccaggaattcaaggctgcagtgagccataattgcatcactgcactccagcctgggcaacagtgagaacttgtcttaaagaaacaaagcaggttctttcctctcagaagcccctctctcttactagagagagagctgttctcctctctctttcttctattaaacctccgctcctaaaaacacaaaaacaaaacaaaacaaaaccaaagcaaaacaaaacccctaaaaaactagcctgggcaacatggtaaaaccctgtctctacaaaaaacacaaataaactagccaggcctggtggtatgtgcctgtagtcccaactattcagggaagctgaggtgggaggtttgcttgagaccgggaagtccaggctgcagtgagccgagatggcgccactgcactctagcctcggcgacagagtgagactctgtcgaaaaaaataaaaataagactgttgcttccatcttgtttgccctctctccttctgagagaagtcagctaccatatcttgagcttccccataaaaggttcatgaggcaacgagccaatgtccctggccaacagccagggaggacatgaggcctgacaataggcacatattgagcttagaaggcaatgctccctccctcagtcaagccttgagatgactgcagccctggctttgattacagcttgtgggcgaacctgggacagaggaacccacctaagccacacccagattcctgacccatagaaactgtgagataataaatgttcatttgtttgtttgtgatggagtcttactctcttgcccaggctggagtgcagtggcacaatcttggctcactgcaacctccacctcccgggttcaagcgattctcctgcctcagcctcccgagtagctgggattacagacatccgccatcatgcccagctaatttttgtatttttagaagagacggggtttcaccatgttggccaggctggtctcaaactcctgacctcaagtgacccacccacctcggcctcccaaagtgctgggattacaggcataagccaccacacctggccaaatgtttattattttaagatgctaagctttgaattaatctgttaagctgcaacagatagctatacgcttttttttagccctttctttctctctctcttccttccttccttcctttcttttttttgacagtctcactctgttgccaggctggagtgcagtggcgtgatctctgggttcaagcgattctcctgcctcagcctcccaagtagctgggactacaggcgcacaccaccacgcctggctagttttttggattttagtagagatggggtttcaccatgttggccaggatggtctcgaactctgacctcaagtgatccactcgcctcggcctcccaaaatgctgggattacaggcataagccaccacacctggccaaatgtttgttattttaagatgctaagctttgaattaaaatgttaagctgcaacagataactatacgctttttttttagcctaatttctttctttctttctttctttcttttttgagacagagtctcgctctgttgccaggctggagttcagtggtgcagtctctggattcaagcaattcccctgcctcagcctcccaagtagctgggactacaggcacatgccaccacaccgggctagttttttgtattttagtagagacagggtttcaccatgttggccaggatggtctccatctcctgacctcgtgatccacccgccttggcctcccaaagtgctgggtagcctactttcaaaccttaataaatgaattgagaaatgtataaaactttggtcagtgcaggaaatcattaaatttgatgaaaggagaaaaagttaaaatgcattgaaaagaaagaggagcaatgagaatttactactaatcatatataaaactgtatttttattctaccattaatataaatgttttggccgggcgtggtggctcacgcctgtaatccagcactttgggaggctgaggcaggcggatcacgagataaggagatggagaccatcctggccaagatggtgaaaccctgtttctattaaaatacaaaaaattagctaggtgtggtggcgcacacctatagtcccagctacttgggaggctgagggaggggaatcacttgaacccaggaggcggaggttgcagtgagctgagatcgcaccactgcactccagcctggcaacagagcaagactctgtctcaaaaaaaaaacaaagtttctttgggttgacctcccaaggtgctgggattataggcgtgagccaccatgccagggtcatatttgtttactcattcatttaataaatatttgtggaaatctttctgtgcaccaagtgctgagttaaatagaaacagtccttgctctcatggagcccatagctcaggaggacagtcaaatatgaaacaaataatctataattacaaattgtgataaatgctacaagggggaagtgcagggtgctgggagagactatataagagagacctaatttaaattggatgataaggaaaaggctctctaaggagatttaaactgagacccgcatcaggatgtgttcaagtcagtcaggcaaagcatatatggtcggggagaaggggctgcattccaggcagaggaaatggtatgtataaggaccttgaagtagaaacgtttcttgtgtggaggaactgaaataaggcctgaggggacctactgataggagatgagctggagagatataccatatcacatagggctctgaaggtcatgctaaggagtctggatttatattgaattcaatgggacatgaaggttgtaactgggggtggcaagggtgtgatcatccagtttaccttgtaaaatgctgattgactgctctgtagagaatagattatacaagataaagtaggaggctgatgcaatagtatagtagagagatgatgatttaaacaaggctctgggcagtggaggggaagagaagacaatggatggatgttgaaggctgaagggagttaggtgatcaggatgactctcaggtttcttttctttttcttattatttatttattttattttgagacagggtctcactctgtggcccaggctagagtgcagtggcgcaatcatggctcactgcagtctcaacttccgaggctcaagtgattctcccacctctgcctcccaagtagctgggactacaggctcatgccaccatgcctggctaattttttgtattttattggagacggggtttcactgtgttgcccaggctgcattaaactcctgggttcaagcgatccacctgccttggccttccaaagtactggactctcaggtgtctgctttaagacaaactgggtgttcggaaatgccctttattttatttatttatttcttttttgagacagagtcgctctgtcgcccaggctggagtgcagtggcaggatctcggctcactgcaagctccgcctcccgggttcacgacattctcctgcctcaccctccagagtagctgggactacaggcgcccgccatcaccacctagctaattttttgtatttttagtagagacaggtttcactgtgttagccaggatggtctcgatctcctgacctcgtgatttgcccgcctaggcctcccaaagtgctgggattacaggcgcgagccactgcgacccgccggaaatgccctttattaagatgggaatgactggcagagaaaaaagcttggagaaatagtgcaattttgacaagctaaggttgaaaattcaaacaataatgtcaggtaagcattttgacatacaagtctggagttcagaagagatgtctgaggtagggatagaaatttgggtgtcaccagcctatgggtagtatttaagccatgagactgaaatctgggaagaggtgagatcatctaggaaaatagttcagaaggaggagagaagagcccagaaacacaatatccaagtgaaagtgtatattctgcaagaaactaggcttctgagtgttgggctgcagcagccagcaggcttcccttttcattgggaaatgaaattattctgttcattgatccatcctgttttgtatatctatatcgactttctaagtgagtcctcatctaaaggtcctagagcagttttttttttccttgctatcagagccaaaggaaggatccaggtttttgggatacctgaatcatacaattttgggaaacttattaaggaaaaagaatacaaaattctaagtataaaattaggcgcaaaagtaaatatttatttagaattgaatcacaacaaattacagattttcaaaagctgacaaatatcacagatttcacaaaatcaagacaaataacttaatttttattaaattattttaattaatgaattattcattaaccacatgacacaacttttttctttttctttttcttttttcttttttttttttttttgagacagggtctcgctctgtcacccaggctggagaacagtggtgcagtcttggctcactgcagcctcttgtttcctgggctcaagcaatcctcccacctcagcctctggagtagctgggactacaggtgtgaaccaccatgcccggctaatttttgtatttttagtggagatggggtttcaccatattagccaggatggtcttgatctccagacttcgtgatctgccctcctcggcctcccaaagtgctgggattacaggcgtgagccaccgcgcccggcaacagcagtgttaactacccacaactagatctctttttcattccctctttgacagagaactgttatttcactctcatcataaactcttgtgagttagtcccggggaaatctcaaagtgatgatttaaggactgctctggaaaccccaaaggctagtattttagtttcagttttgcaagatgaaaagagttgtggagattggttgcacaacaaagtgaatatacttaacactactgaactgtacacttaaaaatggttaaggcaggccgggtatggtggctcacacctgtgatcccagcactttgggaggctgaggcaggtggatcatgaggtcaggagatcaagaccatcctggccagcatgctgaaaccccatctctactaaaaatacacacacacacacacaaaattagctaggcgtggtggtgtgtgcctgtattccaggtacttaggaggctgaggcaggagaattgattgaacccgggaggcggaggttgcagtgggccaagatagtgccactgcattccagcctggcaacaaagagatactctgtctcaaagaaaaaaaaaaaaaaaaaggttaaggcaggggctgggtggggtggcttacgcctgtaatcccagcactttgggaggctgaggcaggtggatcacctgaggtcaggagtttgagaccagttggccaacatggtgaaaccctgtctctaccaaaaatacaaaaattagctgggcgtggtgacaggcacctgtaatcccagctacttgggaggctgaggcaggagaattgcttgaacccaggaggtggaggttgcagtgagccgagattgtgccactgcactccagcctaggcgacaagagtgaagctccatctcaaaaaaaaaatggttaggcattataaagatacatgcatgcgtatgttcattgcaacactattgacaatagcaaagatatggaatcaacttaatgcccatgaataatagactgaataaagaaaatgtggtacataggctgggcgcagtggctcatgcctgtaatcccagcactttgggaggccgaggtgggcagatcatgaggtcaggagacagagaccatcctggctaacatggtgaaaccccatctctactaaaaatacaaaaattagccgggcatggtagtgtgagtgcctataatcccagctacttgggaggctaaggcacgagaatcacttgaacccaggaggcagaggttgcagtgagccaagattgcgccactgcactccagcctgggcaatagagtgagagtccatatcaaaagaaagaaagaaagaaagaaagaaaatgtggtacatatacaccatgaaataccatgcagccataaaaaggaacgagatcatgtcttttgcagggacatggatggacctggaagccgttatcctcagcaaactaacacaggaacagaaaaccaaacaccacatgttctcatttataagtgggagctgccgggcgctgtggctcatgcctgtaatcccagcactttgggaggccgaagcaggtgggatcacctgaggttgggagttcgagaccaccgtgaccaacacggagaaaccccgtctctactaaaaatacaaaattagccgggtgtggtggcacatgcctgtaatcccagctgctcggtaggctgaggcaggagaattgcttgaatccaggaggcggaggttgcggtgagccggagatcatgccatttgcactccagcctgggcaacaagagggaaactccatctcaaaaaaaaaaaaaaaaaaaaagtgggagctgaatgatgagaacacatggacacgaagaagggaacaacacatgctggggcctgtggggtgggggctgggggagggaaagcatcaggaagaatagctaatggatgctgggcttaatatccaggtgatgggttgatctgtgcagcaaaccagcagggcacatgtttacctatgtaacaaacctgcacatcctgcacatgtacccctggaataaaagttgaaaatataaataaataatacaaaaaaaaaaaaagaggagtgctaaggccgggcgcggtggctcacgactgtaatcccagcactctggaaggcagagacgggcggatcacgaggtcaggagatagagagcatcctggctaacacggtgaaaccccgtctctactaaaaatacaaaaaaaaaaaaaaaaaaaaaaaattagccgggcgtgatggtgggtgcctgtagtcccacctactcgggaggctgaggaaggagaatggcgtgaacccgggaggcggagcttgcagttagccgagatcgtgccactgctctccagcctgggcgacagagcgagactcggtctcaaaaaaaaaaaaaaaaaaaggttaaggctgtcattaaaaaaaaaaaaaaaaaaaaaaacaaggtcggccgggcacggtggctcacgcttgtaatcccagcactctgggaggctttgcggattgcctgagctcaggagttcgagaacagcctgggcaacacggtgaaaccccgtctccaataaaatacaaaaaaaatggctgggcgcggtggctcacgcctgtaatcccagcactttgggaagccaaggctggtggatcacgaagtcaggaattcaagaccagcctagctaagatggtgaaaccctgtctctactaaaaatacaaaaattagctgggcgtggtggcacgcgcctgtaatcccagctattccggaggccgcggcagagaattgcttgaacccgggaggcggaggttgcagtgagccgagatcgcgccactgcactccagcctgggttacagagcaagactctgtctcaaaaaaaaaaaaaaaaaaaaaaaaaaaaaaaaaaaaaacccaaaaaacaaagtcatgtcctttgcagcaacttggatgtagctggaggccactactctaggcgaattaatgcagagatggaaaacccagtacctcacgttctcacttaaaagtggaggctaggccaggcgcggtggctcacgcctgtaattccagcactttgggagcccgaggtgggcggatcacctgaggtcgggagttcgagaccagcctgaccaacatggagaaaccccgtctctactaaaaatacaaaattagccgggcgtggtggcgcatgcctgtaatcccagctactcgggaggctgaggcaggagaattgctggaacctgggaggcagaggttgcagtgggctgagatggcgccactgcattccagcctgggcagcagaactagactctcaaaaaaaaaaaaaaatacataaaaggcagattggagaaaggcatacaaatttatataatgtatacatggggagaatcacggagtgattatccattcccaaaggagttcagaagcttatacatcatcctggcaaaacgggttatgggggatgagaagaggaattgtgttgaggggattactaggtagaatgaatggatcaggaaacagcgattaatctgtacataagcttgtgaaagggtctgttcaggtgtacattcttggccttacagggtgtgaaagaaaaaaacaattgttctccttggcgggtctggatctcaggcagaaaaaggaacttcagaaaatttctttcttatttgggaaagtctaggggagggtggagggtgagaatgtcagagagaccttgaggtattggtttccgagtcccagtggtagtattcatttttgttttaattttcatttccttgattattaatgatattgaataccttttcacatgcttatgggctatttgcgtatctcttttttttttttttttttttttttttttgagatagggtctcgctgttgcccaggttggagtacagtggcacaatcatggggctcactgcagacttgacttccggggctcaagtgatcctcccacctcagccttcagggtagctgagactacaggtgcacgtcaccatatccagatagttttttcaatattttgtagagatagggtctcacaatgttgcctggtctggtctcaagggatcctcctgcctcagcttcccaaagtgctgtattgcaggcatgagccaccatacccagccctttcatatcatcttttgagaaatgccttttcaaatctcttactaatttttattggggtgcttattattttcttattgatttgtaggagttctttacatgttgtctggttatatgtgttgttcataacccactcccactcttcactattttagaagtggctttaaagattaaattcttgattgcacaactgcactccagcctgggagacagagtgagactgtcacacacacacacacaccacgcaagaaagaaagaaaagaaaaaaaaggccaggcacggtagctcacgcctgtaatcccagcactttgggaggctgaggccagcagatcacctgaggttgggagttcgagaccagcctggccaacatggcgaaaccccgtttctactaaaaatacaaaaattagccgggcatggtagagggcgcctgtaatcccagctacccaggaggctgaggcagaagaatcgctggaacctgggaggcagaggctgcagtgagctgagattatgccactgcactccagcctgggtaacagagcaagactctgtctcaaaaaaaaaaaaaaaaaaaaaaaaaaagattaaattcatagcaagatctcctctctgctgaaaaaaaaaatagttgggtgtggtagcgtgtgcctgtagtctcagctactcaggaggttgaggtgggaggatcatttgagcctgggagatgaagtctgcagtgagttattatcttgccactgtactgcagcctgggcaactggggaaaatcctgtctcaaaataaataagcaaatatgcacttttttttttccccctgagaccaggtctcattctgttgcccaggctggaatgcagtggcacaatcacggctcactgcaacttcaacctcctgggctcaatcagcccacctcagcctcctgagtagctgggactacaggtgcacaccaccatgcctggctaatatttgtattttttgtagacagggttttgtcatgttgtcccggctggtctccaaatcctgggctcaagcaatccttctgccttggcctcctaaagtgctgggattacagtcgtgagccaccatgcctggcctggaactgttaaaatcttattggtgaatttaacttatcaatataaaatgtccctcttggccgggcgcagtgactcacaggcctggcactttgggaggctgaggtgggcggatcacgaggtcaagagatcaataccaccctggacaacatggtaaaaccccatctctactaaaaatacaaaaattagctgggcgtggtggcacgcgcctgtagtcctagctacgtgggatgctaaggcacgagaatcacttgaacccgggaggcagagattgcagtgagctgagatactgcactccagcctggcgacagagcgagactccgtctcaaaaataaagaaaacaaaagtccttctttatctctaggagtatttcttgctgttagtgctcatattatacatttttaccagctttttcctttgttttcttgattccttatttttaaggtagcatactgtggtagattttattttccaaaggtggcctcaacagtatgtccccatcccacatgctcttctagaaactacatcttcatcaaaagatagagttaaactccctattccttgagtctgggtaggtaggtgcctgcttccatgaatagcctatagtggagttgaccctgtgtaacttctcaggctcagttagaaaaggccatgcagtttctgcatgattctcttcagacactcttggaacccagccacagtgctgtgagggagcacaagcagtccatattgaagaccaggtggagcagaattgaggccttggcccacagccctgggtgatctagcatatgacaactagcaccaacttgtcaaccatatgcctgagatatcttgaaagtggcttcccattcaggtgagatgtggcaaaataaaaaagagaaaaaaaaaaaagaaagaaagtggattctcagctcccagacaagctgccctgggtgacactgcatggggcagatataagccattgctgccaaatactaccaaaattgaagacttgtaagcagaaataaataatctgtaagcagaaataaatgattgttttcagccactatgtttcgaggtgggttgttattcagcagtggatagccagaagtggaatagaaccttacagatggattgtctgtattatttctggattctctggaattagttctctaatctaattaggtttaaaggtattgattaccttgcttccactagtaaagggggcacatgttaattgagccactgaattaggagttgaaactgcacttagccatatttagctttctgaaacagtaaataaaagaaggaaattattgtagtagctggggtgactaatcctatcaagaagaaactggacagtctggacaacatagtgagaccctgtctttacaaaaaaaaaaaaaaatcagccaggtgaggtggtatacacctgtagtcccagatgtttgggaggctgaggcaggaagatcacttgggcccaggaggtcaaggctgtagtgagccatgatttgtgccacttcactccagcctgggtgacagactgagaccctgtctcaaaaaagaagaagcaatcagatcactattacacaattaggtaagcagtatgtctggaatgtatgaggtcccctggggcatctcacagtactcccttgcccagtgattaaagtcaaactataactatcccctacagacaggactgctaacaacccagacccttaaaaatgaagatgtgggtcacctcaccagataggaatcatgaaagcctgggtggctgctgaaggcaaaggaaacatggcatagatagtggaagaaggaagtacagtaagtcctaacttaaggttgtcaacaggttcttggaaactacacctttcagtgaaatgatgtatgaagaaaacaattttaccagaggctgatataaacaagagttaaatcccttaatcagactctatttatggtcatgaaaacatcaacaaagttctaaataaagaccaaagcacttctaatattaaacattgaaaaaaatgtgggctatacatacatttaagaaatattaataaaaataagtaagataattatttacccaaatattctagctcagggccatgggtggctgaagcccatcccagtagctcagagctctaggcgggaatcgcctagacaggtggccattctatgatagggcatgctcacatgacacctatattcactcagactgggaaaatgtagctgcaacaattctcctcctgtacaccgctttgggatgtgggaggaaactggagtacctggagaaaacccacataaacatggggagaacatgaaaactccacatcgacagtggcaccagctggaaagagaatttttctcattaatgttataactaaacattattgaaggacctgttgtaataaacagctttgaccatgtgaataaggggcagaaatgagggttggaatagttatttcttcttttgaatatgtttttgtatattaaacatcttttttctctccctccccactcctctaccatcgaatatactttgtgccaatggtaattaaccttataggatttacattacaggatcattatagtgtgattcagctaggagtgactttatatcctcctgtcctgcaagggttgcttaagtttatgaaggaaactgatcatcttagctggaaacatgactttgttattgtcagttaagaatgtttacagaaaaagtgtgtatagatgccaagatgtagactgtggtggctttgtactatgtgaaattagctaaactgtaactgtatttaccagaatttctttcctagtacagttcttcatcactgttgaagacaagaagactttgtatgcaatttggaaggcagaagtgaagcagtagccagtgcagcgtaccaggcactattgcaacttgcacaggttgtcactgatctgatagtggagtgaggaggcaacgggcctgaggatctttccttcagtttttataattcatgggccaagagtatgtgcaatgccatggcaactgctgatgtcagtgagaaatagacgtgtgttctagtttgtcctcaggaattccagttgtcctttttagattcccctttgcccatgttcttgttcatatccagtactccttccacactactggttaggctgacccatagcggcttcagctctgcactagatgctgacaataacacagcatagactcctccaccagttactattatggtgtcaaatctaatcctacaataaacccctcattctttgtttttcatagtggttgtgcttctccgattgaaccctaatacacagttttcttattctattaccccaacctgaaagtctttgccttttaactgaagcttgattgtttacatttagtgtattcagactttaatctaattgttttctatttgttccccctgttctgttttctgtcctctcattttcgattaagtacttcattgttccattcccttctatgaggttatttattattttactttgctattatattagtagccctggaaattataacatgtatctctgatttactttagtctaagataaataaccatttttattacttttttaaaatacaaagactttgcggtccttgatttatacctgatggtttatatgttgatgtttttgtgtgctttaattctacatctatttaaaactccacaagacactgttgtcttatagtcaatattaattttttacccacatatttcactcaattgctcttgattccttccatctggaatagtgtacatctgctagtgacaaattatctcactttttctgaaagtccttatttcatcttccattttatttttatttatttttattttcttggggggacagagtctcgctctgttgcccaggctggagtgcagtggtgtgatcttggctcactgcaacctctgcccccctgggttcaagtgattttcccacctcagcctcctggtagctgggattacaggtgtgtgccaccaggtccggctaatttttttgtgtgtttttaatagagacggagtttcaccatgttgtccaggctggtcttaaactccttgcctcaggtgatccacacgccttagcctcccaaactgctgggattacaggcgtgagccactgtgcctggccttccattttatttttattattaatcactttattttagagacaggttctcgctctgtcgcccccactaaagtgcaatggcataatcgtagttcactataccctcgaactcctgagctcaagtgatcttcctgcttcagcctctccagtagctgggactataactgaacatcaccacgcccagctaattttcctttttttagacagagcctccctctgttgcccaggctggaatgcagtggtgcgatctcggttcactgcaacctccgcctcctgagttcaagtgattcacctgcctcagcctacagagtagctgggactacaggcgcgtgccaccacgcccagataattttttgtagttttagttgagatggtggtcttgctgtgttggccaggctggtcttgaactcctgacctcaggtgatccacccaccttggcctcccgaagtgctaggattataggcgtgagccaccatgcccggcctattttttcctttttttgtaaagatggggtcacactttgctgtccaggctgatctgaaactcctggcttcaagtgatcctcccatctcagcctcccaaagttctgggatgataggcgtgagctaccactcctggcctcatcttacattttaaaggatattttcattagacattgaatgctagactggcagttagttattttctataagtgtactgaagatactaatgatgtgtatttttctttctttttaccattcttagacttgtcaagagtgtatctatttttattgttatttaaaaataacgaaagtttggtttaagatttttaatgttttccattttattaatttcagcctttgctttatgacacattcccttttcctccttgctcttgattcatttttgtccttgtgttaaagtctgttattattaattcttttttaataataaaaatagttaagactgtagtctggctatttaagtgcctgtagtcccagctacttgggaggctgaagcaggaggatcctttaagcccaggagtttgaggccagcatggacaacatagtaagaccctgtctcttaaataaatagaaatataaatgaaaaataaggccggttgcgatggctcacactcgtaatcccagcttttgggaggctgaggtgggaggattgcttgagctcaggagttcaagaccagcctgggtaacacagtgagaccctgtctcttcaaaaaataaaaaatttgccaggactggcggcacatgcctgtagtcccagctactttgaggtgggaggatcacttgagcctaagaggttgaggctgcagtgagccatgatcatgcgactgcagtccagcctagatgacagaccatgactctgtctcaaaataaaataaaataaaataaaaaaccttgtgaataaattttagcacttatattattgctctataataggtcatgtgaaagggttaacagacagtaaaagacaaagtttttttttttttttttcgggagcttcattttattaatagtatatcttattaagattcttgctttttacagaaaagttgtaaagattaagaaaaaaaattctggccgggagcggtggctcatgcctgtaatcccagcactttgggaggccaaggcgggtggatcacctgaggtcaggagtttgagaccagcctggccaacatggagaaaccccgtctctactaaaaatacaaaattagctgggggtggtggcgcatgcctgtaatcccagctactcaggaggctgaggcaggagaatggcgtgaacccgggaggtggagcttgcagtgagccgagattgcgccactgcactctagcctgggcgacagagtgagactccgtctcaaaaaaaagaaaaaaaaaattcttgctttaatacatatctttttcagcaagtctcctgatttaaagtttttcatccaagtataaattagaaaatctaaactgaaataaacatagtctttgaaatagtaaaatcaattattaatagagaattatccgatttaagattataatggtcatatttcacatacaaatattagtttctggagtagggggtgcttaaccaacagaagtggtaatagtgagttttgctaagttaaaggtacttctatatggctggtggtagttgtatgggatgataccaatgatatactagattgtcagggccatttccaagatataattaatttcaaaatcatatttgcctttaatgtatttcacaagaatataataaatatgagcatcttgaaatcctttgaaaacttgtatagaaaggtaacaaattgcttttactgccataaacactaaaaaaacctatgtagtatatatcagtacataagtatgatgataatgatgaaagactatgtcttctataaagggtcatagatacattaaaaaatcttttttttgagacgtagtcttgctctgtcacccaggctggagtgcagtagcacgatcttggctcactgcaacctctgcctcccaggttcaagtgattctcgtgcctcagcctcccgagtagctgggattataggcacttgcaccaggcacttgcaccaccacgtctggctaacttttgtatttttagtagagatggggtttcaccatgttggcctggctgttctggaaccctggcctcaagtgattcgcctaccttggactcccaaaatgctgggattacaggcgtgggtcactgcgcctggccaaaaaatctgtcatgtatcagttatttatcactgccacaaataggaaggtttttgcttctagtgcacccaaaatttgtcaacaagattaaattaagcagttgctagtaactttgtataaaattatagagcttagtgcataaggaacatactttacaaatatgtaagaaatgtatttatacatatgcagcaaatttcatttctaggactcaaaaacagtcaactctcatttatccacatgcagtttccactctatcttaagggataatttttatttttttttgagacagggtcacctttttttcaccaggtgacaccagggttgctgtcacctaggctgtcactgcagcctcgacctcctggcccaagcaatcctcccacctaagcctcccaagtagctgtgaccacagaatgccaccatgcccagctaaatttttttgtagagacagtgtttccctatgttgcctaggctggtctcagaacttctgagccaagtgattctcctgccttgacctcctaaagtgttaggattataagtgtgagccacatgcttgtccttaagggagaatttttaagactcaggctgctatcactaatataataattaaccattcagaaaatgtgacgttttcctctcaatctttattattattaattttgagatgaagtctcgctctgttgcccaggctggaatgcaatggcgcaatctcggctcactgtaacctccgcctcccaggttcaagcaattctcctgcctcagcctcccgagaagctgggattacaggtgcctgccaccatgcctagctaattttctgtatttttggtagagacggggtttcaccacgttggtcaggctggtctcaaactccttacctcaagtgatccacccacttccgcctcccaaagtgctaggattacaggtgtgagccaatgcgcttggcctcaattattagcatttaatagaaattaacattaccctttagcaatgtagtctctgttgctggggaaatgctgttggaggtcaagtatacattttatgaataatttatggattatttgcagttttggatgtaatcttcattaacatgaaaataacttagagttgactacatatttatttttagtaaaggaatactcaacaatgaaccctgcttaaaaagacaaccctactataggaataagtagttgtctcctaaaaaagtgtggagatatgaaatgtgtggcaaataagtttattttttatttattgaccgagagggtctcactgctgtgcaggttggcataaaatggcgccttcaaagctcactgcatcctggaactcctgagcccaaatgatcctctgcctcagcctccccagtagctaggactataggcaagtgcctctacacctggctaatttttaaattgttttgtatagacagggtcttgctagttttcccaagagggtcttgaactcccggcctcaagtgatcctcttgccttggcttccttccaaagcagtgaggttagaggtgtgagccactgtgccctgccatgttgacttttaaaaaccctgtaataacttccaattgtcctcaagaaaaagttcaattcttttttttttttttgagatggagccttgctctgtcgcccaggctagagtgcagtggtgcgatctcactgcaacctctgcctcccgggttcaagcaattcttctgtctcagcctcccgagtaggtgagattacaggtgcctgctaccacacccagctaatttttgtatttttagcagagacgggggtttcaccatgttggccaggctggtcttgaactcctgacctcgtgatctgctcgcctcagcctcccaaagtgctgggattacaggcgtgagccactgcgcctggccaaaagttcaattctttaacatggccctacaaggacttttgtggactctgctccattttccactatcactgtattctaacaataaaagctgtttgcctagaatgctctttgactatacactgactaccactagcagcaatactacttttttttcgagatggagtctcgctctgtcgcccaggctggcgtgcaatgacgagatctcggctcactgcaacctctgcttcccaggttcaagtgattcttatgtctcagcctccccagtagctgggatcacaggcgctcgccaccacgcccagtaatttttttgtatttttgtagagacggtgttttaccaggttggccagactggtctcgaactcctgatctcaggtgatccacccgccttggcctcccaaagtgctgggattacaggcgtgagccactgcgcctggccaatactattaataatagttacaacctaccgaattcttattaggcatgggacagtttatatacattattagttatactttatgaagtaggtactattcttaatccaggtgtacagacaaggcacagagaaatgaagcaattaactgagaggaacacagctattaaagtgtaggcactttaatctgtttcaatccagatctgtctgaattcaatgatgttcccaaacttggaacatgaaaatatcaactttctccaagaagtctgacatgtttaatatcctctaatagcaaatgtgataaggttagcacttaagacactggtttacaacggacctgtgtacttgatgcctccccaaccggaagataagccatctgaactcacttaaggcggcatgttcacttttgcttccccagctccacagttaagtgtaccacagtttctggtacacgtaatgcgtgttaataaagatttgttgaataatcaaataagcgaaactgcttttaaacagaaagccataatacaatgttattaccttcgaatttggctagagaacatcaccaagcttaccagtttgtgatctagactccacttttccccatttttttcagtgtgctacttttgcttatatccattcttctgtgactttgtttgccacaattccttaaatacttccacccctccttttcataacagcgatctgccgtttgtgaacctcttttacagagaaaaactagaatgttacttttcctttcatagcaattctttaaaatttctgaaagcctttaaaagggtattagcgcaaacatcagagatcgctgaggttaaaactatcttttaaaaatgaatttcaccgtctcaaaaaaaataaaaatgaatttcaaatcaaggctaggctgattggagaaaagcaacctagtatatttataaaggtcttccagtgctgtctaagcagtgttgtcccaggtggcatcctatttttcataatttaccgaaggcccttggtaatataaatacagagaataacaggtgctgcactgagcagggggtctgtctaaatcaacctttttggctccattttttgacaaagggccaagaggttagcgtaatcggtccagtagttctcattaccttcgaggggaaggggaaagaggagaggggcgaagaaaggaaacggggagaggaagtgtggcaaatagaagatattcttcaggtagagccagggctcgggccgcgtccccaggtggcccctccaaacgaccgtttaccttgtcaattttctcttttcaatgaaaaaaaaaaaaaagacatctggctttttaagtaagagaatatacaaataaggaaggtatcaggtctcgtgagaattcggcgccagatccgcgtccggaaccccaccgagagccgccggtccaaccgccgatagctcgcggatgcccccgggggcccgacgccggccaggcttcccctagcgctcccgctacccataagccctcgcgtctcagcgcgcacgcgcagcggcgacggccgtctcaggaagaggaaaatggaataaacaactcggaggaaccagagcgcgagagagcgagtggaggcagaatttaaaaataaaccggcccctccgccttccccacccgcttgccgctgccgctccctcttcccctgcccgcgccctcgaagtccccgtctgggcccgcgcgctcaccccgtcgtcccgcgcggcccctttaagaaaagagaacgagagagtgagtgagagaatcccaactctccccctaccctccctccttctaccccctcctccctcccctctcccctcccccttctccccgggcggctccggctcccgcagcgggacagacccacccgcccaggcttttatccggcaccggcagcgtcttcctttcctcccccgtctatggtggtggcggcggcggctcctcgggcggcggcggaagacgaggctgcggcgttgccatgaacagtggcggcggcctcccgcccccctcggccgccgcctccccttcctcctcctcgctggcggcggcggtggcggtggtggccccgccgggggtcgggggtgtccccggcggggcggcggtaggagtgaagctgaagtactgccgctactacgctaaggataagacttgcttctacggggaggagtgtcagttcctgcatgaggaccctgccgccggggctgccccgggcctcggcctccatagcaacagcgtccccctggctctggctggtgcacccgtggccggctttccgccgggagccgtcgcgggcgggggagctgggccgccccccgggcccaagaagccggacctgggggacccggggaccggagccgcagccggcggaggaggcagtagcgggggactcgatggaccgcggctggcaagtgagtgtttttcgggcggggcgggccgcggcggcggagggcaggcctgggccggatgaggccctgctgccgacgggagctgagcacggcccgcgggctccccccctcacctcccaaggcggtctgagaggcctaggccgggcctgagccctccttccttcttcctgcttcccctccccactgccttcggcaagtcggagagcgcggggaggttgggttcccgggaacgtgggtgggaggactggggtgatgtgaagggggggcggggaggaagggggatgggctgtggcgtgcggagtgtgagaaagggggtgtcgtttccggggggtgtggaaaggggctgggtttgcaggcacatgtgttttgcgtgtccttgtggagtggcgtctgcagagtgttgaggttccctagtggggaggggtgtgtttgtgtgtgtgtgtgtgtgtgtgtgtgtgtgtgtgtgtagggggcgggaggtgaggggcgggcttaaggcttcgtggagtaggttgaaagaacggaaaaagtttgtagaaggcttgcgggagaaaggttttgcaggcaggaaatgctttctaaggattaggagggagcggactgtcgcgttcaaagtgtgctcaggtttaatcgagagtttagagtagggatttcacaaagacgcatttcatctgagtttccctgaaagctagaataagtttgctggtgtcagctgggatcctgtcttctatagctttgtatcaagcaaactcagcattgtgtcttgaatgcatgtcatgtgcagcctgcgtttatgtgcgactgagcacttgggtggggacatcttaaggctgtttatatttctttttcatgtgttgttgttgttgttgttgttgttgttttggagagagtctcgccctgtcgctcaggctggagtgcagttgcgcgatctcagctcactgcaacctccgcctcccgagttcaagcgattctgttgcctctgcctacggagtagctgggactacaggcgcgcgccaccacggccagataattttttgtagttttagttgagatagtagtctcgttgtgttggccaggctggtctcaaactgctggcctcaagtgatctgtcctcctcagcctctcagtgtgttgttatctattgacctgaagcttgttagttgttagtggagtttacaattgaatgtgagcgtaatctgttagagaatgttgcctttacgaatagagccggtgccagatgtccctgttttgtttcttagtatattgagcgtttctaaaccaaataggagtcctactttcttgggaattctggagaactagatcttaaaataatctgataggcagttcaatttgtacatgagaacattttgtctttttcttaaacactgttaatgaacctgataggaagttttagcatttaattggtctatgaggattatttaatatcttccccggggttttgctttcttgctttttctttcgagacgggatcttcctatgttgcccaagctggcctggaactcctgggctcaagcgatcttcctgcctgggcctcccaaagtgctgggattacaggagtgaggcaccatgctgggccaagtgttgttctgttctgttcttttctcctttctctcttctttctttttcttttatagaagtgtttcatttgttgtgatgggcttgactttaatgaagatatatttgctaaggctgataatgctaagaaaattaattttgtaaattcagatgttttgtaaaacaaatggttacttatgggtggaattttatcactttcgagcatcaactttgcattttcaggttaaagttttgctggatgtgtgagtcgtgactcagtagtaatgtttgattagtaaccaatgacactgaacaatagttttcttactgacagaaagagacactttttttttttttttttttgagacggaggcttgcttgtcgtccaggctgaagtgcagtggtgcgatctcggctcacagcaacctccacctcccaggttcaagcaattctcctgcctcagcctcccaagtagctgggttttacaggcatgcgccaccacgaccggcttatttttgtatttttagtagagacggggtttcgccatgttggccaggtgggtctcgaactcctgacctcaggtgatcgtcccgcctcggcctcccaaagtgctgggattacaggtgtgagccactgtgctggccagaaagaggcactttttaaaatgctggtgttagacttcataggtgatctttctaggattctctttttaaaaaaaacttttaaagttttatttatctattaatcttattcctgacagacagctctgacgatcattctaggattttctttttctttttttcttttttttttttttttttttttgagacggagtttcactcttgtttacgaggctggagtgcaatctagtgatctcggctcaccgcaacctctgcctcccgggttcaagagattctcctgcctcagactccctagtagctgggattacaggcaggcaccaccacgctcagctaatattgtagttttagtagacacggggtttctccatgttggtcaggctggtctcaaactcctgatctcaggtgatccgcctgcctcggcctcctagggattactggcgggagccaccgcacctggccgaggattttctaattaacacacaataggtagaagggctgagacttgaaagaggacaggatgtaagcagatgaagatgggaggggaaggtaagtacccttaaggtggaggaaaaaatattagcagtggctcaaaggtgggacatcttaggaaaataactgagatatagggactcgagaggacaggcagttaatgctgaaaaggtattttaaaattaatactttgtcacttgttagtaaaagttgtctgattaaatagttgatttatgtatttagattctgtggtgtttgctttagcttgtctggctgaagcctaaggctcctcttttctgtgataggcttcttggtatctctcagtaattccttatggatggagatttcttcataaggaatcacaacctaggtattactgagagataccaaggagtgggaaataatgttgctcaggaatcaggaaaaaaggttgtgttggtaattgtatggcttttttgagtttttacacttattgttcattttttagactgctttctaccttttactgtattctcattcagtgtgttttgagacagtattgatccgtttattttattttgaagagatgatgtcttgctgtgttgtccaggctggtttcgaactcctgggctctagcaatctcctgccttgacttctcaaagtactgggattataggtgtgagctaccacatctggccttcattggttaattatgtgtgtgaggcagttaaaatagatggcaatttttttttttttttttttgagacagggaccacaggcactggctaccaagcacctctaattattttgtatttttggtagagatgaggtttccccatgttgcccaggccggtctcaaacttctgggctcaaagcgatctgcctaccctgtgagccaccatatataccataatttagtgtttttaatttctatgtttgtgggttttgattgaatcatttgacaacaaaagaaacaaaagatttaatatagaagtacaaatttctggtttccctttaaggatgtctcttacctgtgttggaattagagctgttgatagagcataattctctccattttgactcattccctaactggatgacttttatatctaggcatttgaggttttgactctaactttagcacttcacatttgcagaattgtttttgttttgttggtgtttcagatagtgttaaaaccttggaggtgggtgcatgagaaaactttatctttattttgcagccattggaaaactgaagcacaaaggctttttcttaatacacttagttgcaatgatgtttcaaccttataaggaaactgcaatttgattttttgtttttgtttttgtttttgttttttttgaggagggggttgggagttcttgctgtgttgtctaggttggactccaactcctgggctcaagtgatcctagcacctcagcctcctgagtagctgggactacaggtatgccgtaccatgtagcttacgtaacatttcgtatttctgttagtcttgggatttttctaaggcttaagagtgatttgatttgtattcaactgcattatcgattcttgacatttaatgatgtaattctaatattttcaactggctagattttcaaaatggctttaatcttcaaagtgtacaatttttaacaggtaaaatatgccaatatttgtattttatgtacattatttgaaacccagtagttttaatttaccaaaatacacttttcaattctcctaatgtagttactagtgaataagacatgtttcagatagaatcctggctctttgactagctttgtgactgaacgaatttttaacctttaagcctcagtttttctcatctggaaaatggagatgttatgaaaattgcatggcattgcctgcacatattgaggtttcagtcttagttattgctattattaaatattaataatctatagttaacctctgtatttccttcttcaaatttttgagggcatacattgaagactagtaaaatagctacagattattgaattgtgattgtccaaatggaggagagcagtgccatggataacttgaagttcaaatgttagctttggaatatgtaatgtgtagcgtgtggcaaagctgtttttgtttaagccaagactagccttttcatcccacaaacctatactaagtgacagagaagtgagtactggcgatttgctgttaggatagctggcataagtttaaacatttttattggaataatatacttagtatatcatgaaggctttataatactgttcatttcactcatttaatatcctgcttccaaggtggtaagctctgattaaggtgataggaacaacaacagcaacaaaaaaacataattcagccctaatggagtttacattctagtggggctataaatatctataaggtaatacttggtttcgataagtttttttgtttttttttttttttttttttttgatatggagtctcgctctgtctcccaggctggagtgcagtggcgcagtctcggctcactgcgagctccgcctcctgggttcacgccattcctgcctcagcctcctgagtagctgggactacaggcgcccgccaccacgcccagataatttttttgtatttttagtagagacggggtttcaccgtgttagccaggatggtctcaatctcctgacctcatgatccacctgcctcggcctcccaaagtgctgggattacaggcgtgagccactgggcccggccggtttcgataagttttatgaggaaaactcgagggataacgtaactccaggtgagattgagttaacaaataaagcactttttcctgtaaaagtgcatttgatgagatcgggcgtgttcagagtggtatgatcatagactgaaagtgcatttgaaatgaccctttaagaagataaatgattatcaaaagcaaaccaaaacatcatctttttttttttttttttttttcctcagagcctcactctgtagcccaggatggagtgcactggcgccatcttggctcactgcaacctctgctgcccaggttcaagcggttctcctgcctcagctcccaagtagctgggattacaggagcctgccaccgcgactggctaattctcgtatttttagtagagatggggtttcaccatcttggccaggctggtcttgaactcctgacctcgtgatccacctgcctcagcctccgaaagcgctgggactacaggcgtgagccaccgcgcctggcccaatatcatccttttatatgccattttgaggaatttttcccccaattttaaatgaactttttattttgagataattatagaatcacccgaaattgtaagatacaatacggatatctcatgtactcttcttttataaaggatagtaacatcttttgtagctgtagtacagtatcatggccagtattgattgctgtagtctacttgtttacatttccacggtcttatttgcacttgcgtgtgtgtgtgtatgtgtgtacatattacagatcgtgcctaacttaatggtttggctttcaattttttgacttttttttgacaattttttgagacagagtctcactctatcacccatgctggagtgcagtggtgtgatctctgctaactgcaacctccgcctcctgggttcaagcaattctcatgccatagactcatgagtagctggacttacaggcacatgccaccgtgcctggctaatttctttgcctttttagtagagacagggtttcaccatgttggccaggcgggtctcaaactcttgacctcaagcaatctgctcaccttgacctcccaaagtgctaggattataggcgtgacccactgtgcctagcctaatttgtttttaacttttaatttttttttaaggagacgagctggccttgaacttctggcctcaagcaatactcctgccttggtctctgaagtagctggggtgacaggtggaagccaccgtgccaagctaattttttttttttttttttttttgagacagtttccctctgtcacccaggctggagtgcagtggcgcaattttggcacactgcagcctccacctcccaggttcaagtgattctcaattctcatgtctcggcctcctgagtagctaggattacaggcttgcgccaccacgcccagctaatttttatatttttagtagagatgagggtttcaccatgttggccaggctggtctcgaacccctaacttcaaggctgcctcagcctcccaaagtgctgggattgcaggtgtgagtcaccatgcttggccctcagtttttacatgatgaaaggtacacttttttggtaaaaatttacattggaatagaagtgtataaagtcaaaataaatcagtctcctcatcttattgtccagggttaatcattattaatagtctgtgtgtttagatcttttctacacattgtatggtatagacatatatctagtatatatattaaaatatatgtataccatatatacctaaatatatatattttttcctctttctctgtctctctctctctctctctctctctcatattagcttgggttgccaaaagaaaatattataggctgggtagttaacttccccctgcccctcctccccccatagatccaggaacttgagtggctaggtggtttaaataacagaaaagtattttctcagactttcagaggttggaagtcccagatgaggagttgggttcctggtgagggctctctcctggctatattatctaggtatgtgagcacccaaacctagatggtatagcctactgcatgctaggtgatatggtctataacctgttgcttctaggccacaaatttgtacagcctgttactgtactgaatactttaggcagtggtatacaaaggtaagtatttgtgtattaaaacatttaaacaggccaggcgcagtggctcacacctgtaatcctgatactttgggaggccaaggcaggcggatcatgaggtcaagagatacagaccatcctggccaacatggagaaagcctgtctcctaaaaatacaaaaacttagctgggcgtggtggagcacacctgtagtcccagttactagggaggctgaggcaggagaattgcttgaacccgggaggcagaggttgcagggttgcagcgacctgagatcgtgccactgcattccagcctggtgacaaagcaagactccgtctcaaaaaaaaaaggaaaagaaaaaaatagaaaaggtacagtaaaaatatagtgttacagttttatgtgatcaccgtcatacatttggtttgttatcgaccaaaacattgttaccaacaaatcaatatatgtttgtgtctcatttcagtacttagtaattagtactggaccgaaattttaattttattgcggtttcttacaaaataaaactagcctttggctagtcattcggtctgtgtgaaaatacatttctttgcagatggtccccacattttgaatttacaattcatttatcagaatgtagccccatccataagtctaaggaatatctagatttacgatgattcgacttccagtttttgactttaggatgagtttattcaggcattaaacgcatttttgacataacagtactgacttaaaatagttacatcccaataaaacccttgttaagtagaaactattgttaagttgaaaatgcgtttaattcacctaacccatcaaacatcatagcttagcctagcctaccttaaataggcccagaatgcttacattagctacagttgggcaaaattacctgacagcacagtatactgtatcagttgtttaccctcctaattgagtggttcactgggagctgtagcctgctgccattgtgcaactttgtgacatagtatgataccacgaatcactaacctgggaaaagattaaacctcaaaatctgaaatatggtttctactgaactcatatcatttttcacatcatcataaagtcaaaccatcatagtcagttgggaattgtctaagtaagggtatgcagatctcactaatcctggctgagtcagttggcatgtaggtaatagccctcttccctgaaaaaagctttgtcttttctgatacctcttttggcattctctctcttgctttttctgtaaaaaataaagatactgttcctatttttctaaagctagtttgatttttttttcttttctttttgagacaaagtcttgctctgtttcccatgctggagtgcagtggtgtgatcacagctctttgcagtctcgacttgctgggctcaagcgattcttctgcctcagcctcccaagtagctgagactacaggcataagccaccatgtccagctcctttttgaattttttgtggagatggggtctccctgtgtttcccaggctgttctctaactcctgggctcaagtgatcctcctgtcttggcctccgagaatgttggaattaaagaccaccacaccctgcctaaagctagttttaaattatagcgtgtgtgtttgtatatatatattttttagagatggggtcttgctcatttgcccaggctggagtactgtggtacaatcatagctcgctgcagcgttgaactcctgggctctagcaaatctctctcctcagtccactgagtagctgggactacaggcatgtaccaccatgcctggttatatatttttaatatttaaaaaaatgccagtgtcagaaaaataagaacaatatcttgtttttggaattagaaatgtaatacatgcacaggttaaaaatttaaatagtgcaaaagagtacatagtgaaaaatagcctccttccctccctagttacctgatccctgtctcccagagacactctttctagcttatttggggtagccactgacaaatattctttgcctatactattattcatatgtttatatttctctatgtctaacacattaacacacatatatacacatatgcatgagtgcacacatggaagcctaatgtactctgaattttcttacctaatggcttatcttgtagtttgttccacattcgcacatagaaatctactttattctttctcgtggctgtgtaaatattccattatatgtttatattattagattctttataatggatattttagtggtttatagtcttgctattacaaatgttggcacaaagttatgttttaatgtactatgtatatttatttacatatatatttacacaattatgtgatatatacttaaggagcatatagagtcttcagtaatctggttcacagttgatacattaaaaaaaaacactgtgtggggtgtggcgactcatacctgtaatcctagtactttggaaggccgagacaggaagattacttgagctcagaagtttgagtccagcctgggcaatgtagtgagactctgtttctactaaaaataaaaaaaattagctaggcttggtggtgcacctgtagtcccagctactcaggaggctgatgtgagaggattgcttgaacccaggagacctaggaggtagaggatgcagtgagccgtgatcatgccactgccctccagcaagaccctgtctccacaaaaaagaaaaaagaaactcactgtatttatataccattggttgaaaataagatacttgaaatattcattcatatctgccccggtaaaatttttctccccaatggctcacatatctagaaatagttacataaatcgcgtctttggtaacttaataagttcatatttgtaagtagcctagtagtcgctagaaagtttcatttgggtatgtaataaaattatattgttattgattatttactagtcgatctacattcatgttttgtttgttttgctttgtttttagaggtcttgctctgtcacccaggctatagtgcagtggcacacttgtagctcactgcatgcacccttgaactcctgggctcaagttaccctcttgcctcagcctccttagtagttaggtctacagggacaggcaaccacacctgactaattttttaaattttttgtagagatagggtcttgctgtgttgcccaggatggtcttgaactcctggcctcaagtgaacctctcaccttagttggccaaagtgttgtgctgggattacaggcataagccaccatgccaagcctacattctttatatagatatcttacgctgcttttagagatatcaaatacagcagttatatagttggaaaaagctggaaaggactttatatatctttattttaactttcttattttgctcctctaagtttactctgctgtaatactgatgttcctgaatttgatggtatacttgattgagagatgagatcacggtgaagaaggacaaaatggaatgagggcttttaaattccataagtcagtttttatggttcatagatgctgtgacaatatgtcagctatctctgaagcctccttgatacatgatgggacagggaatcttctgcctactcccaaaactttggaaaattagtaaggcagcatttaaagaaaatttttagcgaggtcctcagatatgatatatattataaaaagatttaatgtgggccaggcactgtggctcatgcctgtaatcccagcactttgggaggccgaggcgggcagatcatgaggtcaggagatcgagaccatcctggctaacatggtgaaaccccgtctctactaaaaatacaaaaaattagccaggcgtggtggcgggcgcggtgacgggcacctgtagtaccagctactcgggaggctgaggcaggagaatggcatgaacccgggaggcagaacttgcagtgagccgagatcacgccactgccctccagcctaggcgacagagcgagactctgtctccaaaaaaaaaaaaaaaaagatttaatgtatatataggtaatatctttgaaaaacttagattatgacaagcattcagcttagtgtaatttgggctaataataaatggagattaattcatttaattggttaataaacatttattgagtgtttactctgttaggtactgttttaggttcttaggatatcttagtgaaccaaatagattaaagaaaaatcccttcttttgtggaccttacctcttaatgggtaaagcagacagtatttataaatataaccccagtaattgtatagtatgttaaaagatggcaagtcctactaaaaacaaaaaggtaatagagtaagaggcaatgggagtgtaggaatagggttgttatagaatgaaatagggatatcaaggtaaacctcactggggttgaaatttgagtgtagactggagaatgatagccaagccagtcatcaggagaaagagtatctcaggcagagggatagaaggctaataggttggtgtggagtgaggaacagggaagaattaggatttttgcttttattttgtgtcaaaaggagtgatagaatctaaggttttaaaagagttctgtgggccaggtgttgtggctcatgcctgtaatcccagcactttgggaggccgaggtgggcagatcaccaggtcaggagatcaagaccatcctggctaacacggtgaaaccccatctctactaaaaatacaaaaaattagccgggcatggtggtgggcacctgtagtcccagctactcggcaggctgaggcaggagaatcacatgaacctgggagtcggagcttgcagtgagccaggattgtgccactgcactccagcctaggtgacagagccagactctgtctcaaaaaaaaaaaagttctgtggcaagagggcaagagagaatttaggagattatttgcagtaatccagcaagagatgatgagatgatggtggtttaggcaggttacagcattgaaaatggcaagaactagtcagatttcagacatgttttccaggtagagccaatataatttcacttggaatgtagggcattggagagaggagtcaagggtttgtttcaagagtgtggaaggttatggatggacttgatgccagctgagatgaggaaggctgcagacagagcaaatatgggagagcagatcaggagtttggttttgaacatgttactttgagagatatattagccattcaagtggagattttgaggagttaggtagatacaagtctggagttcttgagagagattaggactggagatgataaacttcaagtcttcagtgtatacttggcatttaaaatcatggaactgtatgagttcaccaaggaatatggcttctataagaacttgggaaacacaaatctattgataaatcagtaggctattttctttttcttaggagaaagaaagaataggtaagtaacatttgggttctacatatgtgccagtcatgccatatatatatttgcatacactatcccatcacatttaataactatttcatgagatagatactgttttcatttgacaggttaaaactagcccttaaaaaaaaggctagttttaataagcaaacaattacaaatcctctctctatcccctgctatatgaccttaagaaattgaagtcagaggctgggccctgtggctcatgcctgtaatcccactactttgggaaggtgaggggggtggatcgccttaggtcaggagtttgagaccagcctggccaacctggtgaaaccgtgtctctactaaaaacacaaaaattagctgggcgtgatggtgggcgcctgtaatcccagctactcaggaggctgaggcaagagaatcgcttgaacccaggaggcggaggttggagtgagccgagatggcgctattgcactccagcttgggcaacaagagtgaaactccatgaaaaaaaaaccaaaaaacaaaaaaaaatgtgtatcttattacagttgagtccttttgtgagacgaacattcagtgtttgctagattattctaattagctacctttgtatggttaggttagcatggagctgaagataaatgtcccgtttgaaaaaatgacagcccttcagaaaactctggcagtttacagaagaaatacaaatggccaataggtatataaaagttcctaacaagtgaataaaagcaaattaaaacaggcattcacttatttatgttttacctttcaagttgataagagcacaaagattgttgatacctagtgtttgtgtgggtatgggggggaaaagacactctggtatgacgcttttcgaggtcagtattcattaaaatttaagatgtccacatcctttggcacaatagtttattgttagactcattctatggaaacacaggatatatgtacagagttattcaacgcagctgatctgacgtagggaaaagttgaaaatagtgaaattcccgttagtaagggtgttatccatatagcaggatatcatacagcagtaaaaacaagagttttatatacagacaagatgcttaaaatatattactaaataggaagaagaagttacaaaactatgtataatacgcttttttttttttttttttttttgagaccgagtctcgctctgttgccagcctggagtgcaatggcgcgatctcggctcactgtaacctcagcatcctgggttcaagcgattctcctgcctcagcctcccgagtagctgggattataggcacccaccaccatgcctggctaatttttgtattttttttagtagagatgggatttcaccatgttggccaggatggtctcaatctcttgaccttgttgtcctcctgccttggcctccagaagtgctgaaattacaggtgtgagccaccatccccagtcgtaatacacttttaaaagatatgtaagaagaaaagatctagagacagcactgagttgttaatgttagtatttctgtggtggcatgatgggaaacttcgatttctgtatttctgaatattttttcctcaagtctcttataatcagaaaaagaatcagtaaagataactaacatacacacgtacaaaagacgaacccaaacccaaccctccagatgctagcttactacaagatttagcaaaataattggaaatgcatgtggtttgctagtttctccaaaattcagcattagccttctgagctcatccatgggtttggatgatcttaagctgatactttatgtgacaagtaagctggttttagaaataaaattttctctctgttattaaatttctagccgcattactagaaaacaataatggaaaactttttaggccatttattgctttattggcagctttcgattatgtagaaaatagtaattatcttggcatagatctcaaactaaaactgctttattggaggatatttttcggtgagtattcagattgatgatactaaatagcttcacccaagaacccaatttatttagttgttgatattcaagtttgtagtaagttcatcttggaatgtgtatggtattgcagcactccccagaatcagctgtttttaccagagtcttactgcactgcagttcttttctgattgaagaggctaggtaataatgcatatcataaacatgttcaggtcaaaatagtgtactgtatacactccagtgaaacagtgggatctcagctgggtacctgtcgttaagccacttgattcatctaaaatttctgtttcgggattttttggttttttttttcttactataggccttgctgtggctatcttggtgcatagatatgacaacttccttaagagccagtttgccagatagaccttgcagtttgtattttttatatatttatttattttgagacagagtttcactcttgtcgcccagggtggagtacaatggcacgattttggctcactgcaacctctgcctctagggttcaagtgagtctcccgcctcagcctcccaagtagctgggattacaggtgccctccactacgcccagctaattttttgtatttttagtagagacagggtttcgtcatgttagccaggctggtctcgaactcctgacctcaggcaatccacccactttagcctcccaaagtgctaggattacaggtgtgagccaccacactcggcctgactttgcaggtttttttttttttttcttttcttttttttttgagacggagtctcgctctgtcatccaggctgtagtgcagtggcgcgatctcggctcactgcaagctccacctcccgggttcacgccattctcctgcctcagcctcccgagtagctgggagtacagtcgcccaccaccatgcccggctaattttttgtatttttttttttttagtagagacggggtttcaccgtggtctcgatctcctgacctcgtgatccacccgccttggcctcccaaagtgctgggactacaggcgtgagccaccgcgcacggcgactttgcggtttttaaaacaatgttaactttcctccctggaggtctgatacctctgcaggtaactcactgtttactaaatgacgtagtatatgtgttctctaggcactgactagagaatgtaatttaattattaaacatatatttaacatttttgtgctaggtatcatatagatgttggggaatacaaagacatatcaggccggacacagtggcctgtaatcccagcacttcgggaggccgaggcgggtgaatcacttgaggtcaggagtttgagaccagcctggccaacatggtgaaacccgtctctaccaaaaatacaaaaatttagccaggtgtggttgcatgtgtctgtattctcagccactgggaggctgaggaaggagatttgcatgaccccgggaggtggaggctgcaatgagctgagatggcaccagtgcgctccagcctgggcaacagagtgagactccatctcgaaaaaaaataaaaattaaaaaacaaagatgtatcggacatggccctggtcatttgtgagtgcatagattaataaaggagtttgacattataaattatgacatagtatgatatatatatatacacatctcatatatacacacacatatacataaaatgtataacaaactctattcagggatattttgagaggtgatatttgaaatatttttcgaaagatgtatgaggcatacatacctggtagaaaagggcattctaggtagatgagaaaagacacagattttgagaggaagctctattcatagttttgtagtcatctgatgtggttagagaataggccaattatggagagtggtaccagataataagctgtggccacgttgtgaaggcccttctaggatatgctagtaagtgatatgataagatctgtgttttaccacccccaaagctggcagaagacaagaaataaccaaaatcagagctgaactgaataaagttgaggtgcaagaaaccatacaaaagatcagtgaaaagagaagttggttatttaatataataaataagattgctagactgctaactagactaatacagaaaaaagaagatccaaataaacacagtcagaaatgacaaaggggacattaccacctaccccacagaaatacaaaaaaccctcagagactattatgaacacctctatgcatgtagggtagaaaacctacaataaatggatatattcctggaaatatacctcctaagattgaactagagaaaaattgaaaccctgaacagagcaataatgaattctgaaattgaatcagtaataaaaaacctaccaaccagaaaaagcccaggaccaaatggattcaaagctgaattctaccagacatattaatataaagagctggtacaattgctactgaaactattcaaaaaaatggaagaggaggggattcctccttatctcattcaatgaccagcatcatcctgataccaaaacctggcagagactcaacaaaaaacgaaaacttcaggccaatatccttgataaacatagatgcaaaaatcttcaacaaaatactagcaaactgaatccagcagcataacaaaaagctagtccaccaggccaggagcagtagcttaggcctgtagtctcagcactttggtagccaaggcaggtagatggcttgaggccaggagttcaagaccagcctgtgtaacatggtgagtacctatgtctaccaaaaaatttaaaaaattagctgggtgtggtggcacacacctgtagttccagctacttgagaagctgaggtggaaggatggcttgggcctgggaggcagaggttgcagtgagctgagattgggccatggtactccaacctgggcaacagagtgagaccctgtcaaaaaaaaaaaaaaaaaaaaaaaaaaagctaaatcaccatgaacaagtaggctttacccctgagttgcaagactggtcgggcatacacaaatcaataaatgttacccgtcacataaacagagctaaaaacaaccatattatcatctcaatagatgtagaaaaggttttcagtaaaattcaacatcccttcatgttaaaaaccctcaataaactaggcattgaaggaacacacttcaaaataatgagagccatgtatgacaaacccacagcagcatcataactgaatgggcaaaagcttgagaactggaacaagacaaggatgcctactctcaacactgctattcgacatagtactagaagtcctagccagagcaatcaggcaagagaaagaaataaaaggtatccaaataagaagagaggaagtcaaactatctctgtatatgatatgattttatacctagaaaacctcgtcgtctctgcccagaagctcctaaatctgacaaacaacttcagcaaagtttcaggatacaaaattgatgtacaaaaatccgtagcatatctatacaccaacagcatccaagctgagtgccaaatcaagaatgcaatcctattcacaatagccgtgaaaaataaaatacctaggaatacagctaaccagggaggtgaaagagctctacaatgataattaggaaacactgctaaaataaatcagagatgacacaaatgcaaaaacattcgatgctcatggataggaagaatcaatattgttaaaatggccatactgcccaaaacaaaataaatattcaatgcttttcctatcaacctgccaatgacactcttcacagaattagaaaagactgttctgaaattcatatggaaccaaaaaaacagcctgaatagccaaagcaatcctacacaaaaagagcaaagcatcacattacctgatttcaaactatacttcaaggctgtagtaatcaaaacagcgtggtacaggtacaaaaacagtgacatagaccaatagaacagaatagagagcccagaaataaagcctcacacctacaaccatctgatcttccacggagttgacaaaaacgagcaatggggaaaggagttcctgttcagtaaatggtgctgagataactggctagccatattcaaaagattgaaactggacacctttgttacaccatatacaaaaaattaactcatggtggattaaagacttaaatgtaaaacctaaaactataaaaacccttgaaaacctaggaaataccattctggacatacgccccagcaaagatttcatgaggaagatgccaaaagcaatggcgacaacaacaaaaaattgacaaatgagacctaattaaagagcttctgcacagcaaaagaaactatcaatagagtaagcagacaacccacagagtaggacaaaatatttgtaaatggtgcatctgacaaaggtctgatacccagaatctataaggaacttaaattaacaagcaaaaaacaactccattaaaaactgggcagaggacatgaacagacgcttttcagaagaagacatatactcagccaatgagcatatgaaaaaatgctcaacattggctgggcgtggtggctcacgcctgtaatcccagcactttgggaggctggaggcaggtggatcacgaggtcaggagatcaagaccatcctggctaacacagtgaaaccccgtctctactaaatatacaaaaaattagttgggtgtggtggtgggcgcctgtagtcccagctactcaggaggctgaggcaggagaatggcgtgaacccgggaggcggagctcacagtgagtggatatcgcgccactgcactccagcctgggtgacagagcaagactccatctcagaaaaaaaaaaaaaagctcaacgtcactaatcattagagaaatgcaaatcaaaaccacattgagataccatctcataccagtcagaatgattattattaaaaaataacagatgcaggtgaggttgcagagaaaagggaacacttctacactgctagtggggaaagcagtttcatgatttctcaaagaacttagaattaccatttgacccagcaatttcatttttaggtgtatacccaaaggcatatacgttgttctgtcataaagacgcatgaatatgttcattgcagcactcttcacaatagcaaagacatggaagtgacctagatgcccatcaatggtagaccagataaagaaaatttggggcatgtacaccatggactactacacagccatgaaaaagaacaggataatgtcctttgcagcaacatggttggagctggaggtcattatcctagatgaactaacgcagtagcagaaaaccaaataccacatgttctcacttataagtgggaactaaatattgagtatacatagacataaagaagggaacaatagacaccggagccttctgtttttattttttttgagatggagtttcgctcttgtttcccaggctggagtgcaatggcacaaatcttggctcactgcaacctccgcctccctggttcaaacgattctcctgcctcagtcctcttagtagctgggattacaggcatgcaccaccatgcccggctaattttgtatttttagtagagatggggtttcaccatgttggtcaggctggtcttgaactcccgacctcaggtgatcctcccaccttggcctcccaaggtgctgggattataggtgtgagtcaccacacctggccaatactggagacttattgagcagggagagtaggaggagggtgaggaagggaaaagtacccattgggtaccgtgcatattatctgggtgacaaaataatctgtacaccaaacccctgccatatgtaatttacccatgtagcaaacctgcatgtatacccctgaaactgaaataaaaggttttttttttttaatatttattttttatttttgagacagagtctcgctctatcacccagctagagtgcagtagtgtgatcttggctcactgcaacctctgcctcctgggttcacgtgattctcctgcctcactcagcctcccaagtagctggggttacaggtgtacgccaccacgcctggccaatttttgtatttttggtagagatgggatttcactatgttggccaggctggtctcaaactcctgaccttgggtgttccacctgcgtccccctcccaaagtgttgggattacaggcatgagccactgtgcccggctttactctttattttgaaaagataactatagtaggcttttttgacttctaaggatggaaatggggaaatcatttggaacagtctttatgatagttaaagggagtaacgctaaggacatggtttagggcagtggaaatgaattagagggggcacattttagagagatttggtgaagcagctacttgggatgcataagggagagaagggaggcaaggataactaagtttttagttttaaagtacttgtcacatgtcttagagacttttagtaataggcagttggaaatgtgagttaggagattaggattgagtgagatgaatatagtgatttttgaaatgtttgaaataaggctttaaatctcaactctgacactcactaaaatgagaaataaccatatatatcttaaagaactgttgggattgtgcatataaacctgtcaataagtaacacttggtattattttatctaatttatcagaactagggttgaatgtttcacagtaaatggatgagagtttaagagggagagattgatctatttagattgctggaaagttaagtacttgaactatatcgttagttctttatggaattacctcactttagttgtggcataatattcttttctgtacttctattgagaataaatataaaaagtgtttcaagaaatctttcagttgtcttgaagatgtcatggtgttcaatgttctttatggaaaaatccttgtaataatttcttcgaatagtttagtactaggaaaaatggtttttgctcaaacaaattggtatttgttattttactaagcaagcaatttttaaacttccattttccctttttttatcttgtctgtttcaaaatgtctgagcttaatgtttgactgaaatatttttattaacctgtatttttagtttaatctatatttaatcttttattatgtggctctattgtatgttttcgggggcggggagcttacacaacagaaatttattgtctcaggtttggaggctgaaagtctaagatcaaggtgttggctggattgccttcttctgagggctgtggaggataatctgttccatgtctttccccttagcttttggtttgctgacaatcttggacatttcttggcttgtagaaacatcttcccaatcactcctgtcatctttacttgatgttttccctttgtgtgcatctgtgttcaaatttcccttttttataatgtcaccagtcatactggattaggactgccctaatgacctcatctttaattatatctgcagtgactctatattcaaatgaggtcacattccaaggtacaggggattaagacttcagcataggaatgtggtgggggttgggagggacagttgaacttctaacagttgtgtggttaaacaaatgagataataacctgaaatgccttatggagcttcggagttaggtagagaattgagaatttgaacttgttctcttcatgactgtctccacagaagctttatcataagggcaggaagcacagtgtttatagtcattaattgctgttttctgacagtttgactttttccttggtttgtgaactttcgagggagttccagctcttcaaacagacagtatgtcttgtccacctgctttggatttgagtcttgttttacagacagcttctgtgggttttataacagatgtgtaaaatattccagcctacctttttatcatttattttaaaattaaaaagagaaaaacctacatggaaagtttttcctaacacactctattacaaagagcatattagtgtttcatcagaaaaagcaggctactttttgcaaataaataagtagatttggcacctaatatcaactgggcatgccagtatactgaattaacacaacaaccttggaaagtagatgctactgttttagtgttacagaggaagaaactgagacttaagtatactgttgaaggttagtagttggcaactggctgaaacagacctcatggtcagtatttgttaaaagtctatgctcattccacaatccgataaagaaaaggatggtgtgagtatctgctgagggggtagaggagcccctgtttcttgggcctgcactcactgtactgtcatctggcatctctgaggtctcagtttcctcattggaaaagtggaggcaatcagccgggtgccgtggctcatgcctgtaatcccagcactttgggaggccgaggcgggtggattgcatgagctcacgagtttgagaccagcctgggcaacatggcgaaaccccacctctactaaaaatacaaaaaattatatgggcgtggtggcgcacacctgtagaacccaggaggtggaggttgcagtgagctgagatcacgccactgcactccaacctgggcaacagagtgagactctgccttaaaaaaaaaaaagcatttaattgaaaataaaagtttgtacaaatgtgctaggctgggctcagtaactcatgcctgtagtcccagtactttgaggggccaaggagggaggattgcttgaattcaggagtttgaggctgcagtgagctgattatgccactgcactccagcctgggtgacagagggagactttttctcaaaaataacaacttgccaccaagcttaaaaaaaaaaaaacctaacaaaaatgtgctattagattaaggagtaccaaaaagtgaaaggtgtgcataattacagatacatacagtgtagttacagataatttaaggccgaatgcagtggcttacacctgtaaactcagcactgtgggaggccaatgcaggaggatcacttgagcccaggaagttttttttttgagacagcatcttgctctgtcacccaggctgtagtgcagtggtatgatgacagctcactgcagcctcaatttcctaagcccaggagttcgagaccagcaacataatgagaccctgtctctacaaaaaataataaaaaataaattcaaaacaaaacaaagataagataatttacattagtagatagtacagaaatacctgaaaatgtaaaggcttaaatactgtagttgaagacagcaataaaaagtcaaaaggaagtttttttttctcaaatgagtgatataaatagtatcttaagaggtaaaggttttaacagcttggaataattggggaatactttctagagaagggcaaattaaaaaataatgtttatgatgacctgttagaaaacatactaggcactttacatagattatttcatttgattccacaccacaaccctatgagtgagatggtatttaacctcttttttcagatgaagaaatgaaatttacagttacttgctcatgctcatatagtatgtaaatggcacaagtaggacccaaactcaatgtgtaactccaagtattttttctttctcatcatacctgagtcttgagtatgtatattagaaattgattatactccagatggtaaagtgtgggagattttaagcatataatgagtatatcattgtaactggaggagaaagttcaatcgttatatgattcttgtaaagatcttacagtagatgtatacttttattactttacgccatgatctttaatcttttgtaaatattggtgtaaggtattcagttttttccctagatggatactcagttgtcttaagtccatttactgaataatcccccttttcctctactaattaaacgaaaagttttattggccaggcatagtggtgtgcgcctgtagtcccagctacttgggaggctgaggtgggaggatttcctcagcctgggaggcagagattgcagtgagttgagattgtggcactgcactccagcctgggcaacagagctgtctcaaaaacaaaaccaaaccaaaacctttattgaaatgtaatttacatgctattaaattcacctattataagtacaattcagttatttttaataactgtatagagttatacagttttttaaaataactttaagatattgtttttcataactcttaattgaagttttcttggtagatggtatgattttcattttataattcatggcataatctgcatcttataagcattttgcccaagactttgtggccagtaaatggcagaaccaagactcaaactcagcaccttttagaagtattagcatgatagttgagaacaaattgttgaggatatgctaatgtcaaactaagaagtttggatttcatcctttagcgtgagcatcgccagcatcttctctgtaatgccctacttggcacttgtagctgggtactttttggaaaatgtcttctatgatggaactctagtctctgaagatgttccatgtagaaagggttccctactcaagtaaatttgggaagtactctgacttctttttggatgatcacagttcacattgtatacacacatcctgggaagttgtacagtaaagaaatgggtttacttgtttttactcattttcccccagaattttccaagtttcttgaccatagatgaccttttgagtaacactgctctagtatgatgtttttggagaattagactcaattcattaagaggggttaagtctgaagaagaaaattaagctgcaggattggatttttttaaaaagtaggttataattgtgtacatttatctgttaatagtcatggggtaactgctgacagatggagaagttcttatttttttttagaccgaatctcactctgttgccaggctggagcgcagtggcgcgatctcagctcactgcaacctctgcctctcaggttcaagtgattctcctgcctcagcctcccgagtagctgggactacaggcatgtatcaccacgtctggctaatttttgtatttttagtagagacggggtttcaccatgttggtcaggctggtctcgaactcctgaccttgtgatcctcctgccttggcctcccaaagtgctgggattacaggcgtgagctaatgtgcccagccgaagttctgattcattaggtataggatcctttggtccaaagtttgaaattttgtctcttgatttatacttatatatcctttttttttttttttttgtagagatgggggtcttgctatgttgctcagggtggtcctggattcctgggctcaagtgataataccaccttagcctcccccaaagtgctgggattacagacatgagccaccatgcctggccccatttcttttaaaaatttgaaagactgtttagtatagtagcaagatcacttttatgtcccacgtgtaccatttactagtgttgtgactttgggcaagctataatctctgaatcagtttgcttaaccataaaataaaaagaatatcaaccttgccacagttgttattcagatgtagattcatatctataatgattgttcaatttcttattattctatagtgtcttagttcatttctgcagctcttaacaaaatattggagactgggtaatttttatagaacagaaatttatttctcagagttctggaggctgggaagtccaagatcaagtccaaccaaggtgggttggtttggtgtctgatgagggctgctgtctatgcttcaagatggtgccttgttgccacctgctcacatggtggaagggtctaacagtttccttgtgcttcataagggtgctaattccattagcatcatggcatggtccaccctcatgacttaatcaccatctaaaggccccaattctcaatactatcacattgataagtttcaacacatgaattttgcagggggtcggggggacattcagaccattgcattctgccccgatcccttaaatccttgtctttgtcacatgcaaaaaacattaattctatcccagtagtctcaaaagtcttccagcaccaattcaaaagtccaaagtccagagtctcatctaaattaggtatggatgagactcaaggtattcatcctaaggcaaattgctctccagctatgagcctgtgaaatcagacaagttacgcttttctaaaatacgatggtaggacagacacaggatagatacttccattcagaaagggagaaattggaaagaagaaagggatagcagatcccaagaaagcccaaaacccagcaaggcaaacaacattaaatctggatgcctgagaataatcttgtttaactccttttcttgccttctggacacactgggactgggggtgggtcctgaaggcttcagggaaccacgcccttatggctttatctggggcaacccttaatgcaactctcacaggttggagtctggtgcctctggctctcctaggctggtgttggatgctggtggctgcacagttctgaggtctctgggggcagtcttgccttcacaacttcactagacataaccctggtaaaagctctctgctgcagcctgcccctttggcagttctctgtctagcccctgaggctttctgaggaatcctttgaaatctaggtggggatagccatgcctctgagtgtactgcactcctgaagagttagcaccatgtaggcatcaccaaggtttaccccttgtgcccacttttgccctccagagtggaggcctgagctgcacctggctgcacttgagccacagtgggggtagtcagggagtcttgcttgggaataaagggagcagagatgtgaggcaaccctgggcaactgggcctctccctagaaaacagttttgtgctcaaggctctgccattgtgggcctgtggtagggagtagcagccttgaagcaatctgaaatgtctttgggttcattcttccattgtcttgatgaatatcagttgcttccttttatctatatgaatctctttacctttttattttattttttatcttaattttttttttttttttttttttagagatgaggcctcgctatgttgcccaggctggtcaatctccttatcaaaaggtcgcttgatcatgcttgtggtactctcttccaataccacacccccgttttttattttgagacagagtctctgttgcccaggctagagtgcagtggcacaatctcagctagctgcaacctccacctcctgggttcaagtgattctcctgcctcagcctctgcctggctgatgtttgtatttttagtagagatggggtttcaaccatgttggccgggttggtctcaaactcctgacctcaggtgatctgcccacgtcggcctcctaaagtgttgggattataggtgtgagccattgcgcccggcccaatacccatttttaatctttacaacctagccaggctgagaatttcccaaatttttaagtcctgcttcccttttgattgtaaatttgatctttaggccaggtgaggtggctcatgcctgtaatcctagcactttgggaggctgaagcaggtggatcactcgggctccagagttcaagaccaggctgggcaatatggtgaaaccctgtctctacaaaaaaaaaaaaaaaaaaaaattagctgggtgtggtggctcattcctgtagtcccacctatttgggggcctgaggtgagaggattccttgaacccgggagtccgaggttgcagtgagcttagattgcgccaccgcactccagcctgggtgactgagaccctgcttcaaaaaacaaaacaaacaaacaaatctttaattcatttctcacatattactataagcaattaagagaagcaatatagcatcctcaacactttgcttagtgatttatcctgtcaaatatcctagtttatcccttgaaagtttgcctcaccttacacctcttttctacatacaggcactaatgccattcatgaggactctgtccttgtgacttaatcaccttctaaaggtcccacttcagtaatatcacattgtggattaagtttcaatatatcaattttgggagacacattgagaccatagcacacagagatgtaatagttctacaggttgagtataccttatttgaaatacctggggcaagaagtgttttggatttcaaatatttttggatttgggaattatttgcattatacctactcgctgagcatccctaacctgaaaatcaaaaattgaaaatcttccagtgagcatttcctttgagcatcattggcactcaaaaagtttcagattctggagcgtttttggttccagattagggaagtaataataaacctttaatacagatggcaatagagcttttatggaaaagggaattgcagcctgggcacagtggctcatgcctataatcccagcagtttggaaggctgaggcgagtggatcacttgaggccaggagtttgagaccagcctggccaacatggtgaaactttgtctatactaaaaatacaaaaattagccaggcatggtggcacatgcctgtaatcccagttacttgggaggctgaggcaggagaattgcttgaacccgggaggcggaggttgcagtgagctgagatcgtgccactgcattccagcctgggcaacagagcgagactctcttaaaaaaaagaagtgtattgtggctggatgtggtggctcacgcctgtaatcccaccactttgggaggctgaggcgggcagatcatgaggtcaggagatggagaccatcctggctaacatggtgaaaccccgtctctattaaaaatacaaaaaattacttgggtgtggtggcaggcacctgtagtctcagctactctggaggctgaggcaggagaatggcatgaacccgggaggttgaacttgcagtgagccgagatcacgccactactccagcctgggcgacagagcgagactccgtctcaaaaaaaaaaaaagtgaattgcaaactattagtccatggaaacagtgtaggatttacttaaagtagcttgcaaaaataaaggattgaaggactgaaaaattcttgatgatatattcttggtaattaaggtcactcacatatcttacacttaagtaatttaaatttaaaagtattctacatgcattttctcattttttttttgtttgcttttttttttttttttttttttttgagatggagtctcgctcttgttgcccaggctgaagtgcagtggcgcaatcttggctcactgcaacctctgcctcccgggttcaagtgattctcttgcctcagcctcccaagtagctggtcttacaggtgcccaccaccacgcctggctaatgcttgtatttttagtagagacagggtttcaccatgttggccaggctggtctcagatgaactgagctcaggtaatctgcccacctcggcctcccaaagtgttgggattacaggcatgagccaccgcgcccggctgtatttttctctttgaacacctggtgaagtaggttggatatgtgcctgttcttggtaattaaaaaaaattaatatatttatgatctgtataggatggaataacgtatcattggttagtgattttttcctaactgcactccaagtatctattcctcttttctcccttccaaaacaagaaaagtcaaacgtaagtatatgcgtgtgtggaatgtttactttaaaaaataataattttaggccgggcacagtggctcacgcctgtaatcccagcactttgggaggctgaggcgggtggatcatgaggtcaggagtttgagaccagcctggccaagatggtgaaaccccatctttactaaaaatacaaaaattagctgggcgtggtgacgggcagctgtaatcccagctacttgggaggctgaggctggagagtcacatgaacctgggaggcagagtttgcagtgagctgagatcacaccactgcactctagcctgggcgacagagcaaaactccatctcaaaataataataatacaataataataataataattttaaccattgattactggctatatcagcactcccttgccacctacccttgttttggttaagtccagtcaggtgtttcctctgctagggagcataagtcgtcttctatcaaagttgtgtatctgaaaggaatatatataccagtgttaatatagtgaaaataactaccagaaatttgtgtgtttattgggacaaattctatttcttaatgataaggtgttattaaaaggtgggaactttataagatggttttattgtcctctgacaatagtttaatattcattaattttaccagtatttcattttgcttatgtgcagtggaccttgctttcgaggaacttaaaaattctattaagacaagacattgaccatagatatttgaattcttggcatgttcaataattgttctattggcttgtacaaaatgtgaaaagagaaaattggatttgaaattaataaacataataaaagcctttgaagtgaaaagcatttaaaatcaaaatgctatattagaaaacaattttactctagaattgtactctattttggagtaaccattctattttattaggaaaatgtgaagagtagatgccttaaggaatggaggaacctctccccttatggattgctctgtcatcatcatcatcatcatcattactgtgaaaataactacattgtaaagaaagtcataagataaatgacgaatgtctttatttattttttcatttttttttgaaatggagttttgctcttgttgcccaggctggagtgtaatggtgcgatcttggctcaccacaacctctgcctcccaggttcaagtgattctcctgcctcagcctcccgagtagctgggactacaggcatgcgccaccatgcctggctaattttgtatttttagcagagatgaggtttttccatgttggtcaggctggtctcaaactccctacctcaggcgatccgcccgccttggcctcccaaagtgctgggattacaggtgtgagccaccatgcctggccaaacatcttccttttaaccaaccacatgacccaaaattgttaacattttgacatatttagtcatttttttctgtgtatgtgtaagcacacatcattaccctcaaataaaaatgtgttcccctttcacttcacattgtaaatggttattacactagaaaggaacaaaacttgctcctgttttctactacactctcacacaacacttttgacaccagaagtgtggagtttttttcccacaccagccaattctccaattctctggttaccacatgggtgtcctacaattcaattatgacactacttggagttagtgcggactccagaggttaagagctcagtcacgcaagactgctctccacttcagataccagtgacatgtagcgggtcctcagattatccacacttctatccgacttggctacaaattgggagttcccacgacccctcctcaggtttgataatttgccatgatggctcatggaactcagggaaacacttgcttgactggtttattacaaaggatacagatgaacagtcagatgaaaaggtagaacaaggatcttttttctctgtggagttggggtgtgccaccctcctggctcataaatgtgttcaccggcccacaaactccttgaaccccacagttaagggatttttatggacgcttcatctcgcaggcaagggaaattattaactcagcctgtagcccctctctcctcactggaagatggttgggtagggctgaaagttccaaactggtaatcagggcttggtctttctggtgaacggctcccatctaggtacctaacaaaagtcacctcattagaacaaacgctactcctatcaccctggaaattccgagggatttaggaggtctgtgttaggaaccgaggtcagagaccaaatatttgaaccaaagatgctcccagcaccaaatatttgaacaaaagatgctcctagtgcctatcacttaggaaacaagtttttttaggagctctgtgccaggaactatagatgaagacaaaagaaatatgtatttctttcgcagtgtcacagacacatacaattatttagtcttggctgggcacggtggctcacgcctgtaatcccaacactttgggaggccgaggcgggtggatcacgaggtcaggagattgagaccatcctggctaacaatggtgaaaccctgactctactaaatatacaaaaaattagccgggcgtagtggtgggcgcctgtattccaagctattcgggaggctgaggcaagagaatggtgtgaacccagggggcgaagcttgcagtgagccgagatcacgccactgcattccagcctgggtgacagagcgagactctgtctcaaaaaaaaaattatttagtctttattatcattttctataacagtttattatggaaaattttaaactttgataaaagtagagaggatagtgtcatccctgtcacccagcttcaacaatgattgatttttcccagtcttattttgtctgtcctccaattttagttctgttttgctgaaatattttaaacatatcctggacattagttaccatgactttgaattatttcatagtagtttttctatggatttacttaatcattcttctgtcgttagacacgttaacctacaaggaagaagctgaggcaaaattaatataaacagagtcagccaggcatagtggccctgtaatcccaacacttatagaggctgagatgagaggatcacttgagggcaggagttcgagaccagcctgaggatcataacaaaatcgtctctacaaaaacaaaagaagagagtttatttgggccagacttgagggttgcaacccaggagcatagattcaagttgccctcaatatatcctctgattagcagtagtggatttttaaaggtaaaatggggggacagggagtgaaagtgtgtcaggaattctcattggcttacagaaataacattgattcagctatacattgttaagctgtagggtgatggttacagtgtccaatgtggcattattaggttaatttatagctacttacggcaatagcaggcagtttcaagagatgagcacatagctcaaagtggggagtaggctgtgactgctgtctcattttaatacctctctgggcctgatattaaaagggtttgcattcttcggataataaatagttcttttttttcccatttcacattgtttcaaatttcttgttaaagatgaactttttatatgtaaatatttaggtgtttctgatgatactattcagccatatcctgaagttgtaatcaccaaaagatatgaaccattaaaataaactttttgtaattataaatgcagtacattttcgttatggatgttttgggaaataaattttaaaaactaagaagaaaataaaaattacctcagattgttttccaaagagacccaacatcccttctatccacatttttgtagtttgcttcttactggggttgaagggggtttctcaatgactgcctggagaagagcaagcctacttgcggcccatcttattgttaaactagcagattagaaaatagctgtatgctaagcacttactaggaagtagcatctaagacacagtgtcccgttgattgccctaatagttctacagtccttcagtatcatcctaccctaaactctaaagagaactatcagtattcctgaatgccatcctattgctacctctgcagatttttttccccctgaattttgagttagtgtgagtctgctggtttgtttcaaaagatgtgttttgagaaacagtcttgagaaaattgcttctgtttaccatccagtgattcacaggagaaattgttgtccttttactgagttgaagaaagaaaacttgatgaagaaactggaaatgcaagtggtagaaacttaatcatattgtgcctgggggctatttggtgactcagaaaataaattatttctgtgggaaataattagtcagcttgagcactgtttaacatatttctggagccaacccaattttatttgatcttacctgttatgaactggtaaataaaaataagtgtgacagatttgagactttacaacttatttaggaacacagaagtgaaatcaatgtttcatcctctgaaataattttaaatacttgaattttccttctctttcagttccaggaatggatggaggtgctttaactgatacaagtctcacagattcctattttagcaccagctttattggagtcaatggatttggaagccctgtagaaacaaaatatcccctgatgcaggtatccttagtataaattcatattgcactatgaagtttattctagggccagaggacatatagagtcttcatttattcctacatttgttgagtgggaggtgagattttaggaggcagtgagatgggtgagatgtaggtaaactatctcccatggggttggagttaatgagagcttttgtaagtgggggtttggtagggttaggggcaagagtgacgggagtatgtagagggtagttagagactaatttcacttgtgtattttgtatgtatgttagttaaacttggtagtgattgcaattttaaaattatgttttaagcaggttatacatgtattataaaagttaagttacaaaagggcctccctctcgtcactactcatcacttttccagttaaccttcctagagttagctatcattactggttacaagtttcctgtgtatcctctcaggaatattctttgcatatagaagcatagtgctagttttattttgtttaatgcttaaaatgttgaatttaaagtcatagtacttggagcattttacattaaaaatgtctttgaattttttttaaccccactttgttctttttggctctttttttcccctttatcatatgactgcatgcaatgcttaggagatttgtgtttagatgagtttttgttgatttgtattgcacaattttgtagaattggaataaaattggaaagtattctagtgtttttaattggaaaactgccataatagtaaaggcaatgtattgtcctttctagtttctgtgatgtactactggatggttttctccattattacaataggatatttaaacacaagagaaattcatctttacgtttctctccctctctctctctggagacagggtcttgctgtgtcacccaggctgaagtacagtggcgcaatcatggcccactgcagcttcaaccttctaggcacaagcaatactcctctcttgcctcagcctcctgagtaggtaggactacaggtgtgtgccaccatgcctggctaataaaaataattttagcagagatgaggtctgtgttgcccaggctagtctcaaactcctggtctcaagtgatcctcctgccgtggcctcccaaaggaggtattacacgttgggattacaggcatgagccaccactcctggcctagtgtttatacttcaagttggactgattttaagggtttgtatgaaaccaatgcttttttgaattattttaacttatttcgtgtagatatgcactctaagggttgtttataaagaaacatgcacagccatatatagaaatggttatgttttatgaacaatataactagtttaatgcatagttataccttattttaactgcctgtgagccacaatttcaggtactttttaatatatatttttgtattaaaattacctcaggagcttagcttttttcttctcttttaaaattatgcagacattaaataagaagttgagtaaacagattcaggactctagaattaaagccagagctagaaattcttaacttataatttttaaggcattgagttagaagttacatatgagacaaggatttgtgggcatgggatgaagggccttacaggatggagagaccatacaggctatggagtgagtctagaaagcatagaacgtgtttagagaacagaaaatacctaattttataagctctataaggtgtatgaatggtagtacaaatggagaaagggtattagagcatttactcattttattcatagtcaacgggtaccctcttcagtggatattggaatttatgttttacagacaaggaaacttagttatgtgttttgcccaggctaataagttatggaagcacaattcaaaataggtctgtagctttggctttgaatacctgggtagtgagtaaaattttcatttcatgtggtggtttttacatagttgtaatccaagcagtaacacttacaggaagattagattgtcagtaatgtgaacagtagattggaggggaagaagcaaagagagccagtcttaattggttggatacttttatttctgtattcctcagtgatgttataaataaatattttgtttttcagagaatgactaatagtagcagctccccaagccttctaaatgacagtgccaagccatattcagcccatggtaagacctgatcccttttgcttatgtgtgtctgtgtatatatttcttactctaaaagtaatatacaaccattgtagaaattttgaaaattgtaaacgggcataaagaagaaaataaaaattattatcttcccactcagatctaactattgagatttagattccaggccaggtgtggtggctcatgcctgtaatcccagcactttgggaggctcaggtgggaggaatgattgagcccaggagtttgaaaccaacttgggcaatataacaagaccatgtctctattattaaaaaaaaaaagaaaagtgtataagttatatacaaaaatttcaacatgctattttattaacatcttgctctttgcactattagttatttaatattaaattcatgttaattttaatgaaggtaagtctgaaaaaccaggaagaagaaggcagagaaatgaagcagcagtctatatgtactacattgtgaagagatttaaggttcctttacgtaagggcatttaatatattttttaggatttagcagaacatgtaatgagattaataaataaaaaattaaagctcagaaatgaagataaatatttaagtatatctcacacatgccttttcagagactcttctcatttgtaaagtgagaaataattaagatatataattttatttgtaacttctttctacagagtagtggaattttgaacctacaaaatctttggatttcatgtttgaaataaattttgaaaaactttattatttctgtcttaacttaatattttactttatctttttagtaataatatcaaacatctggtgatagactttaaaatatggaatagtttgcagagtaaatggttttaaagccttgctgatgtgttgaaatccaagacaggatctctcagagtctatggttgacactgcccccacccctcaccctcctttttatccttcccaagatatggtctcaagattataaacctttatttactttaggtcaacttactgccttcataaacacactcacaatagtatggttaagaggtttttttctcttatttgatttttcttttggttctagtcaaatagatctatcctgatccatatagcttttgaatatttgagcaaattggttcaccagtttgtgttttatttgctcagaaaatatttgaacataactgtgtgttaggtactaagtttaattattgtgtcatttgatttttataggcattgtcaaattaaacagttattagatttgcgggttacccaagttttatgtgtggaaacttacgtaacttacctttcagatcctctaacatcacctgcttcatccttgtttaatgactttggtgccctcaacatctctcagagacgaaaggtaggtgaaattgaaacttgaattaaactaaatggaatttagaagtgatgttggcattgttacctatgtagtgtcaatgtttttgtaagtggagggagagctttttatgggctttagtgtttttcctgccttttgtttatcctttttctttatctttttatatgtggaaatttatttgatctctgcatggaatagagattttgtgtgaagggatgaaatcctgcttatttttgttcagtttatttatctcaatgtattctgttcttaagataacatctaatttaatgttaagttgctgttaatgtgacccattgtaagcatgttaatcatgtttaaactttattttttgatggctttatctaaatttcaaaaattcttccctaatttactcctgattacaaggcaaacttaaaattttcaacatttcataatgggcccaacaatttaaaaagttgaaaatctcttcacattagaaatttaattttatttggaatttagattgatagaccatgtatggatttttgaagtattttataaggactgatgttgtgacaagttgaataatttgatgcctttgagtcttaatgagaatcttgttaatactaataatcatctagagaagatagtcttttttggttaggatcagcaacagctaaagatgttaaagaggttctaaatcttggtggaagttattataaagttataacattgtttcctaagtaatggaagaaagacccaaaatttaatgagagtaataaatgtaaaattaactaaagctcagaaatgaagataaaatatttcaacatatctcattaatattaattttagaataactgatatgaacttaagatacttttaagaaggatctgatcagcagatagtataaaatgaaattcaagaagactgtggtggtgttggcttcacggtgtatagttatccccaaactcgttgagttgtatacattaaatatgtatagcgttttacatgtcaatcagacctcaataaagtggtttaaaaaattcagaaagactagattttcttaagagaaaaaaaagttatgaagactgatataaattatgttaaaacctcatgtacctaatgttatttccattttgagacatggatgagaataagaaggtaattacaaaatgctttttagcaactagaattgatagactaaaatctgtgggtttaatggatttccttataggctcttatcatggataaatttaccctgctttacatacttctcttataaactggaatacttggtttctaaatccgtatgttagcagtgtaataatagagttggacagaaacagacccaggacaatagacaaagcctaacaatgtggaagcaagcagtaaaatgctgaaaagcgaatacaacctggaaatcaagttatctggagctttttatgggaaaacagaaagtctttaaattttcttaggtattccctaatcactttttctcatttataaaataatcagttaacttggctgggcaaggggctcaggcctataatgccaacactttgggaggccaaggcgggagaattgcatgagcccaggagtttgagaccagtatgtataacataccaagaccccatctcttataaaaataaaaaaaattagtcaggtgtggtggtacacacctgcagtcgcagctgaggtgggagagtcgtttgagcctgggcggttgaggctgcagtgagccaagatcatgccactgcactccagtctggacaacagagtgagaccctgtctcagacaaaaaaaaaaaaaaatcagttaataactagcatttcagacatacgagtagaaagtaaaactagaatgacaaattaatgtttaaaagtatttctaatataagaggttagtgggatgtgtcttaaagtggaaatatatgatttagagctcctgacatttacttttgagaaaataataaaaattattagaaattgagaatatatagtacctattctttttataatttattttaatacaataaaatgttactagaaatgttactagaaatttgaaaataatgttagtagaaatgtgacctaaatatttggagagatattagaatatatccaatggaagcagactaatatagaaaaatgagcactctactgtgatatttgaggccctggatctcccattttgtgacctatggccaactttctaggctgtaatcatcccatctgtgaaatgaagagcatgacctcatcattaccatagttgctgtggtgtccttcatctctaaaacttaatgtctgtctaaattgaaagcatccatatgtcagtttctacctagaaatttgtggttcatatattcatatagcttgaaggactatattttcttgccatttatatttaaaatgatgtgtaatctacagacacagagtttttccagtagtgagcaatatagttagaatctttgtgggtacaggttgcatatattttaaaattgttaatggttgagttgagaaggtttcaaatctcaaaatctctttacattagaaatactcttggcataggagtatgacatattacacatagtgaattaaaggcatatgaaaaaatgtctgtttaacgaagtaattttagtggaagtaactcaaaattatatgaatattgtaattccaaatttatctcagcaggctagcatgattacttagtggtattttgttttacagtgatataggagaacaaataattaaactatgcttaccactatttcatagctagtgaggtaaattattttctgaaaatctcagttgggccagtctctgagccagatatgctaacttttgcctgtgggattatgtgatttactggggtcagaatagtcaggtatttttatagtaggcagttttactatatgctatgtggacaaattgaaaatgaaggactgagtttttttttttcccttaaatctaattggagatgcaatacatgaacctacaagggaacatttactcagcagcatattaattagtgccaatttaaatatttgatgattgctaggtagcaaagaattctctagatcctgaagaatttatggagaaaagatgttttgaattgggttttttgtggatgaggaatgtatagaggcaaagatacctaggcaaaaggtatgcttgcttacaggtgatagaggtaggagctttagtaaactctaattcttcttcattctgagaatcatagataaactaagaaatacggctgaggccccttagtatctttaggaacttcaagggaaatgtgggatgtgaaaaatagtacagtctgttacaatggctcatgcctgtaatcccagcactttgggaggctgaggctcgagaatcacttgaggtcaggagttcaagactagcctggacaatgtagtgagacctggtctctactaaaagccaaaaacattagccaggagtggtggtgaacgcctgtagtcacagctactcgggaggatgagaggtgggaggatgacttgagcccaggaggtggaggctgcagtgagccgtgatcactctaatgcactgtgtgacagagcaaaaccctgtctcaaaaaaaaaaaaaaaaaaaaaaaaggcccaaaacaaaacaaagtacagaagggtcacagccatatatctaggctgtataattgttgttaactatgtgagaaacttcctgaagagttgtgtggtgagaatgtatgccttagggcagtactactcataatgtgtcatgggaccagtgctagtctgtgaattgtctgttaggagataaacactgaaaataaatgtctagagacttctataacaatttgataatactgtgacattcgaatatggaatcatttttctaattatctttattttacaaaattataggaccatgatttataggagattttttaaaaagtgatcttttttgatgtttgagaagcactgattttcttttatttgtcacattaggaatgcctaattttatagagagaaaaagtaaccattatttgaggtttgttaaaaataggagttaatatacaagagattattacatgagtaaaccttaatagcaagatagataaaattaaatttgaccactgttatgaaaagaagtagttttgagagtcactgaatcacaaatgtgatctagacaagcattaaaatttccaatgagaaattatttgggaacaaaatatctttacaacagagttagatattggaatacagatattcataaatgaagtgattcagtgctatgatatcttgctgatgattcttgctaagatagaagtgtttatgtagggcaaccatgtatgattgaggcaaatcccaggcaaaatgagaaatctttcaaatttgtgtcagcttggctttctccttttatatctttctgggctattgcccttcttcatcttctttttttattcacctagtcacatttttattcagcttccccctacttcttccatttctttggtttatacccatcgtttatatttctttggtttactttagtatgttgtttcagtcaatatgcggttttatgtggatatttgtattatatttttaatacggagataacagattttcacttctgtaaatttttttaagttttaataacaagttaaattctttggggttaggaggcaaagacttttgaagtatcatgtttatctcttctgttcttgcttttaaagctttttgttaggactagggaagtgggaccaaagggagctggctggttcgtctgctgatagcttatttttgaggagatgtggttgctagaggtacagttctggattattctgcttgagagaaaaattcaccagcagtacttttctccgctttcttctttgtttgaacctagcttgggtctcccttttgcactgttgtttatcttaagagcacccatctctctctgttacaaaacttactgatgataaatattttatgttttctgattaacttgacatttaaaagttttcttatagcatttttattctaaagtcttcctttgaaaaatgatttttacattatttctattctaggcaagcaaatatggaataacaaagactagagcatatttacggtagagttcttctatggaaaaagataaagtaaatttggagaaattaatctgagtatagcatagacaatttggaatgtaaatcttaatccttctgatggttaagctaggccttttttgcatattgaatcaagtattgatgtcagaaaaaataaaggagaaaatggagaagacattgaaaaataactaaaattttaaaggagattgtaatctaaatttaatctgtaaaatgactgtttttaggttctttatgtatgttctcaaagaaataatgttttacttggtatttagatttccagtaagccacatcattatcttttacccattgagtattgttcactaatgtttctggaaaattgtggcgagaattccaaattaatgccctcagaactattatgctctgaaatcactaaacattcattcacctccgcttgtcaagatggaggagggaatgtgtgccatctcagcctaagccaagtttaggagagcttttaggcttagagatatgttttcctttggaaactgacacagttattggagtccaagttcggggtatggggaagacacccatgtgtggttcctgtttatagcttactcagagcctcttggagaattttaatttttcaaagaacaaacagcaggaatgataataacacggcagtgttggatagtggttaaggctttagggtttagagttagatgcgaggcagtcaggattgaattagtgttgcttcactgattatctttgtgtcttcaacttagtaaacctttttgtttcttcatttgcaaaatgagaatgtggtacctagtaagtaaggttgttttcaggactaaatgggacatgttgcctggcacagaagtgttgactattattggtagtaggtagtaagtggtgttggtcaaattttgaactttgcttggaaattgttaactgttgttaattaagtatccctggctactcactctgtatcaggctgtactaaaattgtcctctggaaacgtggttctgtagctgctctgaggatgtctaccttttctttgagatgttcaggcctcctcctcccccagtattaattttttgccttcttcctcacagaaacttcttcctgttagcttctcaaacatgtcctccagatcatgtgaaaatccattgggggtttcttgcaacataattgcagacagatagaaacttgattttatttatatgaatgatgattttccgtatttgttccagataatatggtaaacctaaataattattttataaattaaatgttttatattttatcatatcatttagttacatcaacagttctttgggagagattattttttctgttttgggaaatagaagtttgagagatcaagtaatttgcatagaataatataaattacatagggcaatatgagaagggtaagttgactgagtttactctagggtgaaaaataggccactggtaatatggagaggaggagataaaacatcgtttaaccttatgcctgcttctttttccacttaagtgatttttttcaatgtaaatttctgtcaaaatggtttctggggcaagaatagacaattgaattttttataattgacagacaacttttcagaaatgtagcacaaattatattccaactaataggggctggtttttctacagtcttgaaaacactgggctataaaaatctttaatatttttgtaatttcacaggcaaaaaacttcatttaaatttgatggtgttgtagacttctcttttatgtttattggtcattagtgttattttatgtccttttctcatttcctattgggctattttttaaattcattgtaagaggtctttgtacattagagatgtaaatctcttctgtcacatgttacagtttccctccattttgttattggtcttgaatttcacaagtaatttatgctgtcagttttgaaatgtcatgcttactctgtttctctcatactatgtttaaaatagcaaaatattaagccaatttttgttaaaataacatggaaatctctgctctaatgagttagtaattcgaatataaagggccgtccttgtttttatataattaatttgaatacactgtgatttttattgtgaatgatctctagtaatcagtttcccttagtaaatggctatgtgttctctcttttctctgctttttaactggtaggcttgaatgttcttcctgttggttatctccagtctcagtctattcttttcttaaaatatacaagtaacattagattgaaacttgctaaaaatatggtagttcttatagagaaagactttgagagttgacttttctttcctgctaagtaaagagtattcgtggttgagtttccaggattgggttgagataaagatgtactttggaaagaacagattaaattttgttttaacaagtgtgaggttcaaccatgtacttcctgtactttattttaattggcactttgtgtgcagcgaccatttgtttttgtttaatccagaaaacttcctccaaattcatgattgtaggagaattttgttctgttgattgatttttaaaaagagctctcatgagtttgttttggaagcctttttttttaaaggtgtgtgtggtagtatggtgtttgatgctttatcatatttaaacgtgaactgaaatttttttatgccttttatatacagtttgtaatactgttggctgtactcatcatctaattttatagctttgaagattttgagttcttatacacagtaatggtagtttaagtaaaaccatggtgcatttatctcttgaacctacaaactagtagatcattctaaggttagctggttggcttctttacactctggtcattctatttgcgaagtgtagtagctgatatttaggggcctagcattattgatagctcatccctattttcctaggaggtaggtatggggaatgaattagtaaaggtgaacttaaaattctcatccacaaacatgctagcctaagctccaaattaaatgtaaccaaaaccgtgtggttttccccaactctgttttattcccaagatttgttgtccttgtattttgaaaacggggaaggagaacttttaaattctagttatttgaatgaagtctttatcagttctcattgattccatccatgctaattaaatacaaaaatatttcttcatttgggtatatgtattttgttatcttaggtttagctagaatgacattaagattgtaatgtgttaaggagtattacagaatgtggaattgatttctttgagttggatatgagatgttatagttaagagtacaattgttggaacctgaccctatgttaattttgagataataggcaagttattttaaccttctctcagacttacttttatcatctgtaaagttggtataaaataggcgctatgtcccagaattatgtgaattaaatacattaatggatatagtgtttataatgccttgtacttgtcaaatggtagttattgttatagtctcctatttatgatctgcaatttaaaagtttgtttatctaattatgtacaagacgacttttcattatttaccatctttgtttaaattcaattataataaaactcatttctgaaaaagtgtacacatacaagttaaataaaatggaaaccttttgctaagaagccagtagacattctggcagctacatagtgacagctacatgggagactgaggtgggaggtttgagttcaggggtttgaagctgcaatgagctgtgatcgggccactgtgttccagcctggacaacagaacaagactgttaatataatgaatgcatttggtaagggactgaaattgatagaaaactttaatgatcattacaattgatagattatcatggaaataactttcttgtttaaaaaaataaaactggcctggcatggtggctcatgcctgtactatcaccactttgggaagatgaggcaagaggattgcttgagactagcctgggcaacatggtaagacccgtctttaaaaagaaaaagccctcgtgagatgactcacacctttaattccagcactttgggaggctgaggtgggtggataactcgagtccaggagtttgagaccagcctgggcaacatggcgaaacactgtctctacaaaaaatacaaaaatgagcttgacttggtggtgcacgcctgtagtcccagctacttgggagactgaggtgggaggatcacctaagcccaggaggttgaggttgcagcgagccgtgtttgcaccacttcactccagcctgggaaacagagcaagaacctgtctcaaaaaaatacaacaatttttttcactcaaaatattttattaactttggcatgctattttatttctttatatctggtacgtattgtggttccagtctaaagcacaaggatataagaagttgcagttggtgttccagttctttagaaattgaatgtgcccttgcatagcaaggtcttccaactgattttatttttggtagcataaaatccctttgtaacactgagattttaagaacataagtaaagactgctttgtagacttccttaaattactatgtagataatgtttgtccccctcaatgacctgactcatagcagaagctacaaatacgtgtatatgtgtttatacatgtaaattatgttctgctgtgtttgatataatttatttttctcattttttacgtatttttgttttttgaggggcagtgtcttgccctgtttcccaggctggttcaaactccgacttcaagtgatcctcctgtctcatctacccaacttagctgggactacaggcacatgccaccatgcccagctaattttttaaattcttgtggagactgggtctcactctgttgcccaggctggtcttgaactcctggtctcaagtgatcctcctgtgtcagcctcccaaagtgctgagattacaggcatgagccacctcacctggcccaatgaatgatttaaatgacactttaaaatgatctatgttttattaatcagaacatctttacaaacttgaaaaatagtagtatacaaatgtgaaatatctcttttcagacactgcttaaacgagtatatgaatttattttcttttacagcatcaactcagcagcctatctcctgacactcctaagggtcttaggtacatcaattgagaaatctctggcctaggatttattatatatttatttcaaaataagcctgcattttttttgcaacctcctctgactcctaatgagcttctttctgttcattaaatatcctgatactttagcatatctgcaattataagaattaaatatcaaattataccattaatgattagtggttaatcacttgaggccaggtgtttgagaccagcctaggcaatatagcaagacctggtctccacaaaaaattttaaacagttaatggagcatggtggtgtgcacgcatagtgccagctatgtgggagactgaggtgggaggatcgtttgagctcaggggtttgaagctgcaattagctatagttgggccactgcactgcagcctgggcaacagaagactgtctagaaaaaaaaagaaaaagaaaaaaattacattgtttcagagtgtaaatagtgaaatgattacacagtgattatgtttttgatgttcaaaggaggtttttataattcacggcattggaaactttttgtcctgaagcaacagttttctctagtttattattaatgagtagaccatgatatgtaataacatgtgactgataatgtgaggcattttggagatggtgctgttttgcaattaccaaaagaattaaatgctctgagaattggtctgttacttagtagctttaactacattttttatacaagtgctggtatttatagattgttcttctagctgcactctgaactttttgggagaagagaatagatcttcttgatcattttatttttaagaatgatagagaagtttatactgaaatgttgagtaaatcaaggaatgaaaaaatatacatgtgtgtcctaaaattaccttctgttctttcctttgacatagtgagtctagaggcttacctcccttgtaatgagagtggacttcccttagccctaaaccactggaactggcttttatgaagtggggcaaaggtttttggaaaagctagggctttgagggctacaaatagtgatcttaaaagctctcagtgttagccaggcgtggtggctcacgcctgtaatcccagcactttgggaggccacgccgggtggatcatgaagtcaggagttcaagaccagcctggccaacatggtgaaacctcatctctactcaaaatacaaaaattagccagatgtggtggtgggtgcctgtaatcccagctacttgggtggctgagccaggagaatggcttgaacccaggaagcagaggttgcagtgagccgagatcatgccactgcactccagcctggggcaacagagtgagaccccgtctcaaaacaaaaaaacaaaacaaaacaaaaaaactctcagtgttaagatcaagctccaagggggcaaggagctacaaggacttgcgatgctgaatttttaaacccctaccccttttcattttgaggagtgactccaatttctgtttgtatcactagttatttcttctccagatctctctgacgttattgagaactttagtactcaaagtgcgatcaccagaccaggagcatctgcagtcttgggagcgtctttagaaacacagattcttagacctcgctctaaggcctaccgaatcataatcttttattttagcaagatccctggaagatttctgtgttcactattgtttgagaagtgctactctagaatatattttcaaaccttttcttcttgaaaacttttattcaagccttgagcttttttgtttgttttgatattttacttttgagacagagtcttgctcttatcacccaggctggagtccaatgacacaatcttgactcactgcaaactctgccccccgggttcaagtgattcccctgcctcagcctccagagtagctgggattataggcgcgtaccaccacgcctggctaatttttgtattttttggtaaagatgaggtttcaccatgttggccaggctggtctggaactcctgacctcaggtgatccgcccgcgtcggcctcccaaagtgctgggattacagacgtgagccacctcacctggccaatttgtttgttttttgagatagagcctcactctgttggccaggttagagtgcagtggcacagtcatagcccactgcagctttgaattcctgggttaaagtgatcctctcacttcagcctcctgaatagctggaattataggcacaccaccacacctggcttattaaaaaaattttttggcgggggtgggggtagagattggggggttctcactatgttgcccaggttggtccttgaactcctggccttaagcagtcctcctgccttggccttccagagtgctaggattacaggtgtgagctgctgtgcctggcctctgctggatgttttaccacgggaaaaggggtgtattagtccattttgacactgctataaagaaatacccgagactgggtaatttataaaggtaagaggtttaattgactcacagttacacatggctgagaggcctcaggaaacttagaatcatggtaagtgataaaaccatcagatctcgtgagaattcactcactatcacgagaatagcacgggggaaaccactcccatgattcagtcactcccttaacacatgggcattattaatataatttgagatgagatttgggtggggacacacagccaaactatatcaaggggattgggaattttgttatacaatgttaacttacacgtgtggagcacaaaagctggttatcaataggatgtggcattttcaaatgcttttatttcataataaccagcaagatgggactggtcaggctatcaagaatagaggatcaataagggaatttaccttttttgggggaccactgtgttcataaggttggtctaggtaaggatttctagaagctcggaagggaagaggagttggtgcttttgtttgctctgaaggaggggcttggatcttaaagaactgaaaaaactttagtaaataaatatttcccttaaaattgtgtttgccctgtttattttctgatcttctctttaacctcttcctttcccttagcacctgcttccagttaatcaccaatagtggtttttaacctaccagatgttgccacaagtaagctttcactagttctctatttctgttattattgcctcaagttcatatccttctttctcgactagtgattcgtagccagggcagttgtgtctttttacccccagagaacatttggtaatatctggagacatttttggttgttacaactgggtacttggtgcttagtggtatttagtgggaggatagagatgctgctaaacatcctacaatgcacaagacagccccccacaagaaagaattatccaaagtcagtagtactgaagttgagaaaccctaacctagactactgccagagtccactaatttgtcgacctatttccacttttactccctcttccccaattcttcctccacactgccacagaccttcctttctaaaatacaaatctgattttgtcatttattctttaccatggaatgatcctcagattccttagcttaggaaacaatatgtttatatttacttatttattttaatttttttttgagagatgagacatgtcactgcagccttgacctcctgggctcaagcgatgctcccacctcaggctccagagtaggtgggactataggcatgggccaccatacccggctccttttttcattttttgtaaagatggggtcccactgtgttgcccaggctgatcttgaagtcggctcaaacagtgctctcatctctgcctcccaaagtgctgggattacaggcatgagccactgtgcttggcactaaaacaatactttttttttttttttttttgagactgagtctctgtcacccaggctggagtgcagtggcaccatctcagctcactgcagcggcaccatctcagctcactgcagcctccgcctcctgggttcaagagattctcctgcctcagcctcctgagtcgctgggattacaggcgcctgccaccacacccagctaatttttgtatttttagtagagacagggtttcaccatgttggccaggctggtctcgaatttctgacctcatgatccgttcgcctcagcctcccaaagtgctgggattataggcgtgagccaccgtgcctggccaatactttttaaaaattgcattcaagcttcatcttttgttctcaaacttcaccttctgctaatggtgaactgcatacttgtggtttcctctaaacaccatcatgtctgtatacatagttttcccctaacctatactacatacttccatctcatattttcctatctaggcacatttattcttccttcagaactttactcaggcattcacttttctctgtgaagctacctttgtttctgctctattcatacatgattacttatgcattgttatatcacagtgggttgtggtttgtttacatttctgttacctcctagcctttaatctgtcttcgagcgtaaggtgtgtgttgtgttccaaatacttagaacagttcctgatacaaagtagattctcagatgtttagttgaaagtacatttttttcttcagggattaattagtaatttggaaattagcttatagatgagatattgttataatttacattctatgcaataaaacttttctatgtaatctttcgcctcaccatcatgttttacattgctaccatctcttttcagatgttattttgtattttgtcgcttataatggtaccttaaatagtattgataccttagggcaggagtgtccaattttttggcttccttgggccacattggaagaattgtcttgggtcacacataaaatacaccaacactaatgatagctgatgagctttaaaaaaatggcaaaataatctcaatgttttaagaagtttacgaattcttgttgggccacattcagagtcatcctgggcctctggttggagaagcttgctttaggatattttcatttagttacacagagaagattttacttttggattagagtttaatctctggctatttattgaaaaaatttagggtttataatggcacatgtttagagatctcttctacctattgaggagaggctttaggctagttaagggttttagggcatggagtggaaggagaggaatgatgaattccctttttgaaatgaagaaacgtaatttaatgagtgcagttaaagagggaggatgatacgttggatgtatttaaaaccatttttggggacgggcacgtggttcacgcctgtaatcccagcactttgggaggccaagacaggcagatcactggagcccaggagtttgagaccagcttgggcaacatggagagactcccatctccacaaaaagtatagaaattagctgggcgtggtggtacacacctgtagtcccagctcctacggaggctgaggtgggaggatctcttgagcctgggaggcagagattgcagtgagctgagattgcaccactgcactccagcctgggagtgagaccctgacttaaaaaaaaaaaaaaaaaaaacccaagaaacaaaaactaaccaaagagcaacaaccttttttttcaatgttgtttactgtactactacatagaaagtgaattgtattgactgtaataactgtgtcaaaagtacatttgaggcccagtgcggtggctcatgcctgtaatcccagcactttgggaggccgaggcaggtggatcacctgaggtcaggagtttgagaccagcctggccaaaatgatgaaaccccgtctctaataaaaatagaaaaattagccaggtgtggtggcaggcgtctgtaatcccagctacttgggagactgaggcaggagaatcacctgaactagggaggcggaggttgcagtgagctgagatgataccactgcgctccagcctgggcgatggagtctcaaaaaaaaaaataaaaagagacactgtctcaaaaaaaaaaaagtacatctgaatttgtgaaggatctgaattacggaagaccttttaaaataattttcatgcattcagatatatgacctggaatttaggtgtccatgtataaatcatttgacaacctgagattttgattaagtaaacgttctttgatatgttgaactttcctgatagaacaaggttaattttagctcagaaattttcttaaatttacatatatgtgtgtgtatatatatacgtgtgtgtgtgtatatatacatatatatgtatgtatatatatatatatatttttttttttttttttttgtagagacggagtcttgctttgtcacccaggctggagtgcagtggcgtgatctcggctcaatgcaacctctgcctcccaggttcaagcaattctgcctcagcctcccaagtagctgggactacagatgcacactgctacacacggctaatttcttttgtattttagtagagatggtgtttcaccttgttgctcagtctggtcttgaactcctgagctcaggcaatctgcccatctccgcctcccaatgtgctaggattacaggcatgagccaccgttcccggccaaatataaattttaaattagtaagtgtctaattagggttatattactgtatgtcagagccttgtagttttctatttgaacacaaaaatgtacaatttaattcttatactctttccaaggaattaagttactagaaataacttgctttaaaattctttcacttataacgtggttccatggcatgaatcactaagggtacatacttattcttattcacaaaatttccctctatggcttttctaaagtatgatagcaaataaaaaaaaatgttccctatgctatagacatagagagtaactagattggttcaagattgcataaaggtggaggtatgttagtctcataaaactctgttcgttaggctgatgtggtggctcatgtctgtaatcccagcactttgggaggtggtggatggcttgagtccaggagttccagaccagcctgggtgacataatgaaaccccatctctactaaaaatacaaaaattagcctggcgtggtggcacatgcctgtagtcccagctacttgggaggctgaggtgggagggtcgtttgagcccctgaagcagaggttgccactgagctgtgattgtaccactgcattccagcctgggcgacagaatgagacactgtctcaaaaagaaaaaagaaacaaaactctgtccactgccataattattgagtaagtaggcattctagttacctttctcaatgcaagtttagttatttttgtccttgtttttttttgttattgttgttttttattgtttgtttgtttttaaatttgggatggagtctcactctgtggcccaggctggagtgcagtgtcatgatctcggctcactgcagtctttgccttccaggctcaagtgatttttctgcctcagtctcccaagtagctgggattacagacatgtgccaccatgcttggctaatttttgtacttttggtagagatgggctttcaccatgttggctagggctggtctcgaactcctgacctcaagtgacccaccacctcggcttcccaaagtgctgggattaaggcatgagccactgcacccagccttgtcctctttaaatcaaagacagtatagcagatgcacacttgtggagtggagaatctaatttgcatggaataatttacataggcattatttgcaagattttgaaatttggaaattatgtcttttttaaattggttctctttatactagaaaacattattaatatatttgactggctataggtttttttttgtttttttttttttaatagagacagggtcttgcaatgttgcccaggctgttctggagctcctgggctcaagtgatcctcctgcatcaacctccaaagtgctgggattacaggcatgagccaccatgcctggccagcatctttttttgaagaaacttaattttaactctttgtttcagcagtcttatacctcatgacagaacaatgagtaaacatatattttcttatttcagagtttaaattaattaccttcctaagcatgaattagtgttttctgaagggaaaaaatacatacaagttttccttaagatgcagtctagtgcaaatttgctgtaattaagagaagtgagatagtggaaacaagcactaattttcatgaataaaagtcctgctaaccactattaagatagcttattaattttcttataatgttaggcaaataatttatgattttattgaataatttattcattatcaatctgttcatattattgagatttaaaagaccaatttgtgttactgttttgttgttgttttttagtctgaggtttttttttttcattgaatactttagggtgaatgcctatttaagatagagtgagttgtactcaagtctaacgtgcatagaattaaaattttttaaaaatcaatttattaggaaacaactgcgtttttaaaagtgggttagttctcagtaggaaataaagtaacaagatggtgagctgaaaaagttgtagtttggcgaactttataaaaaagaaaaatctgtattctgtgtccttgaaaccatttcttcatattgcagtgagaataggtaagtgacagtagaaaaaattttgcaaagcatttttctttgctgataagttaaatttctattcattaagtaaagtcgtataaaatcagattaaatgtatttttctaaaaacatctgttgctttatataatattctttagcccattaggagtgtgggttattttggaggtgtgggtttggtgcaggggtgggaggtggtgggtggtggtaaggatattagaaggagtgttttagaaacttgtttcctatcccaccgttcccagtatcctgtatatgttagttatgttagtttagattagtgtgggggatgttaggagtggcctggtttctttccttctttttcctagccaaggaagtatcgcctggggatgctggaggagaggctagttccgatgggatcaaaggcacgaaaagcaaagaaccctattggctgccttgctgacaggtgtaaatcaggagtacccatcaatatggtttggtggaacagagtcacagaaaacaatttacaggtaaaaataatttttattagacatttcttgaaagtgaatgtcttggctgctttctgtgtctgtttggggtggtggttgtgaaaggattggatgacttagctggtatacttaggtaattaaaaaaatttttaatcagaataaagttagtgacccttaaccaactaaatgattttttcttggtggctttttgagcttttcctctttgtagaatattttacttttgtttgtttgttttttgttttttcagacagagtctcactctgtcccccaggctggagtgcagtggcaccatcttacctcactgtaacctccacctcccagattcaagataccatgcctcagcctctcaagtagctgggactgcaggtgcacaccaccatgcctggctaattttttgtatttttagtagagatggggtctcgccatgttggccaggctggtctcgaactcctacctcaggtgatctctgccttggcctcacaaaatgctgggattgcaggcatgagccacctctcctggccgaatattttactatatttagttaaatttagtttttctgttttcaattttgttaatacttgagttcaattatttttactacccaagagttattcaggataggactacattgaagagtcatataaggccgggcatggtggtgcacgcctgtaatcccagcactctgggaggccgaggaaggcgtatcacctgaggtcagaagtttaagaccagcctggccaacatggtgaaaccccgtctctacaaatatacagaaaagaaaagaaaaattttagccaggtgtggtggggagcacctgcaatcccagctactcgagaggctgaggcagaagaatggcttgaacctgggaggcggaggttgcagcaagccgagactgcaccactgcacccactccagcctgggcaacagagcgagattctgtctcaaaaaaaaaaaaagagtcgtataaaatttattacacaaagtcacatttatttggaaatctgaagaacaagatgcttcatatgttgtctttttaacatttttactaggaaacaaaaattatatgtaaacaaacttgtcaagagttgctctaaaactaacttcaatagtatgttgtcatagagtcattacaaatacattccatctttgactgtaccttttttgtcaatactgaataatgcaaatgaaaatttatgtcaggtagtttctatataatattttgaagtaccaacaaaaaaatttatatgccattttaatctggattataattttatttccatttttaaaaaattgataattattctgtaatattgttttattaaccaaatttcaatttagccagaggtagaatgtctttactcccaaacttgcatttaaaatatatcccaaggcaaagcctataatcccacatgtacataccacacacagaaaagatataacaaaggtaacaaattggttttatttctgtttccaaccttatgttataaataggttccacagtattttgttctgtttattactgatacatgagtagtatctgtattgccttgggcataggaataaataaattattccaaaagtaaatattgcaaaatgtagtatttgctccagctgatattttggtaatattttctaaagataagaaaagacaggggtttcatataaccatatgcttcaaatttcattggaaagttttggctatgtcaattatgaataacagtatagtttttttaactgaatttgcttgtcttttatatcagtagtggagaggtttttgatacgggttgttacaattagtttttagtttaaaaaagaaggtctgaagaaaaaaattggaccacagctatttaagagcagatacaagtgaaattggaattacttgtaggttgtgggggtgaaacacttaccaatgcagaggtgtagccactcgacctctccacgactgcccccattatcctggtggcagttctgaggtacttttttttttagaatagcttgaaaaatctttaggttgattatagttatgttttatttataattaaaatagtaatagatttgcattaatgtgtgaaatattgaattggtgttatctgaatctaatgtttccaatactgttattttatacttcaggtagttcttttcctttaaggacataaggaatgctgtacccaaatttagagctttataatctctaaaatgtttcactttaccaggcacatgttgaagtactgaaaaatactcatctcgtctctattactgtctgtgtagattccaaactgggggtctggaatagtttatacaaagcaaatagtatgtcaatatatatttttgtattggagtttttatctttttcttgtgagagaaaagtaacttaccaattccataccatttttttttccttttgtgtgattagaaagtatttttaatatcgttttgtgttttcgacatatactagttaaaagaattgtgtcaggagcatattcatctttcctgttccatttgtttccttaaatcttaggtcctctcaatcctagggtcagaaaaatgttttaaaatattttatgttaataattatggctatgtttctttaatggttgtcttgtgccaggcactgtgctaagctctttacgcgtattgtcttttggtattgctaatagcttatgggatagatgttactgctagatgaagaaacatcttcagagaagctaagtagctctaaggttaaacagttagtagaggaacagatatttgagtccacttttgtcagactcaaaatctctttacttctatgtgctgtagctctagtaactacagttggtttaattatctaactggttaactgaatttctgcaggacagcttttgaggatgaggatgcatccatagttgtatagacacgggctgtaacttacgtatgactctgcagcatgtaagctctgtcatttttccttgtgcttcatctttttcctctgtgccatttaactacttttctttctggaactttaaacattcctttacgttcatttcttaatcttgacctaacatcttggtctttttctacttctgaaaacaaaggaaaaccaacaaaccaactaacaagaaacttaacaaaaccttggtccaagtttccgagctctgatggaatgcagtcattcatactgcatttattctcttcagtgctggatttctttcaagaggcttatgattccctaccctttattacttagtaatcttttaactgattttttaaccaaatactttatgatacgaaggagcctgtctgccaaacatggcatttattaaacagtgatacatttgaaaaatacatatgtggagctgctaattagagaaacagagaagcttaaaatttttcttaatcttttgtacgtttgtagagggtaaatttattcttcatatggctgtttgagatattgataagacccatctgatctccattaatatgtttgtaaagtccgcagtcgggaacctttggaatggtttccactcttttctctaaatttccttaccatccatttactccttaaatgtctgcaaactggtgttaccaaaattttattgaaattgctctcagagttttccagggatctccataattgccaaatccagcagttttattgagcacttaatattgctggctacttttttattgtgaaactctctctgtctctctctctcttttttttttttcgagacagggtctctgttacccaggctggaatgcagtaatgcaatcatggctcacctcatagtctcgacctcctgtgctcaagcgatcctcctgtctcagtctcccgagtagctgggactgcaggcacatatcactgcacccacctaatttttttttttttttcactttttgtaaagatggggtcttgccgtgttgctcaggctgatcttgaactcctgggctcaagctatcctcctgccttggcacgccaaagtgttgggattacaggtgtgagccactgtactggccatgaaatttctttctttgcattttttaataaaaaaatttttataatacaaaaaattagccgggcatggtggcgggtgcctgtagtcccagctacttgggaggctgaggcaggagaatggtgtgaacctgggaggtggagcttgcagtgagcagagattgtgtcgctgcactccagcctgggcaacagagcaagactccatctcaaaatagtaataataatttttttttttaagagacgggggagtgggggtctcactctgttgcctaggctgattttgaactcctggcctcaagtgatccttccaccttagcctcccaaaatactgggattataggcataaacgaccacaactgcctgtctttgtacttttaactctttgtttcgtccctggctccatgtgagctcctgttcttggttcacttgttctttgctttttcttgtatgtcattgattctgaaatgttacttttagaattgtcttctgagttcaaggctcagattttctgtgcctctgatacctttgcatgtgggtaaatatgccactctccctacaaatctggaaagtctagaaatacggtttaatttttggttttccagatttactgcttcgcatatattctcctatactccttcttcagtttatggcattatcttccctatctctgagactaaatattccttccttgccttctctttcattctacctcttattttttttttcccccctggattacttttttaatctaacacttattataagaaggaaactactgtgctttgacagatcattaattaaaatagaatatattggacagtgtacattataacaataatcacatattatccccatttgacaacagaattgggccttaggaaagcttaatgctggttagtggtagagctgcaattctagccaagatctgttctaaatcttgagattttcctgctatattatctgtctctaattcttacttttttaaagtctacagtatcttacccctcttcccttttttataaatagtgagattgtttattccttacgcatatacagcttctgaataatttttgtcaattttttttaggatttattctacctatctgagtttatctcttcatatccatccatatatactacatcctaaccatatgaggtcttttatgttacataaaatataaaatacattgtcagttctctgaaccattgttaactgagcctgaaaaatcttccttctttttcctttaagagatggctcaaatactactttctctgggattacttgtatacacagcaggcaggatagaatatatatatgtatacacacacacacacacacacaatttgtttaacttactttactattcctagtgtatttggtgttttacagttacttcattctgttttgtattaaatttgtttgcctgtttgtctttttctactggattgtaaatacttgaggttaagcatgtgtttatttctgtatcctgaaggtattaggttggtgaaaaagtaattgcggttttgccattacttttaatgcaaaaactgcaattacttttgcaccaacccagtattttacttgtttttaaatgctactgtttaatttttttctttctttctttcttaattttttttccccccagacagggtctcactctgttgcccaggctggagtgcagtggtgcagtcttggctcactgcaacctctgcctcccaggctcaagcgatgctccctcttcagcctcccaagtagctgggaccacaggtgtgtgccaccatgcctggctaatttttttttttggtagaaacagggtttcaccgtgttgcccaggctgttcttgaactcctggcctcccaaagtgctgggattacaggtgtgagctgccatgcctgaccttaattttcttttattgggtaatatatgtaattttgtggtaatttattttaagacttttctatattatttatttatttacttattgagacagggcctcactctgttgcccaggcaggcatgcagtggtatcgtcatggcccactgcagcgtctacctcctgggcttaagcagttctcccactttagcctcccaagtagctgggactacaggtatgtgcaactgtgcccagctaggttttctttgtatttttttgtagagacagggtttctccatattgctcaggccggtcttgaactactggactcaagtgacccacttgcctcagcctcccaaagtgctgggattacaggtgtgagccaccacactgggtctggcttttctgtatttaaaaaaattaatcatagactttttggggcttattttgaaatgttagagatcttccatcttaaagtttaacattatccaagtattcttgctattttttaatcttttaagccttgtaatagacttaattacctcttgacagtgttgtttagtgagaaagcgtctctgcttttcttttttcttttctttttttttttttttgagacggagtcttgctctgttgccaggctgtagtgcagtggtgtgatctcggctcactgcatcctccaccttccagcttcaagcgattctcctgtttcagcctcccgagtagctgggatacaggcacactccaccacgcccagctaatttttgtatttttaatagaaatggggtttcaccgtgttggccaggatggtcttgatctctctatctcttgacctcgtgatctgcccaccttggcctcccaaagtgctgggattacaggcgtgagcgaccacgcccgaccagcttctctgttttatatttttttcatcatctcagcccagacaccaagcaggtggtgaatggaagatcacctgagacaccacatcaaaaacacttcatttcacctaagtgcaaattcactttgatctttcctttagtctttgcccaggatgtttacctatcactggatggttacctgtcactttgcctgaccaatctgtatgtgaattcaacattttctatttgttctatgactacatagttcaaattgccattgcttgggcttgaaatattttatcacctgtcctacagagttgttgtgaggattcaaatttccaagcacataatagatattaaataaatgtccattgtccagttttaccttatcaccttatctcctaaagttgatgtttgtttatatttatttagagtacagcctgcagttatattcatatgtgcttaaatcatgatatgtgtataatggggcagtgacacttggtctcttttaagggctcacatttaaatgctaactcacttgaatattttgaaaaataaatgctttttttgaaaggacaacttaatgtgttttttcctgtgattttacatttcattttgaatgaaaggttctgggaaatgtatgattttgtaaatttctcataatattgcaggttaagatttacctaaaagtagtgatacattaaataaaatcacgctaattttgtctcagacttttgaaaattgtgtggttgtgaatcataagttataatattactattgttttagtgaagtgatacaattaaataagaactgttggactgtgcatgtgttaggggatccatttgatttcattgtctccttgtcagcatctcttttgatgctacttttttccccttgtctgattaaatggcattttttgtaagaggtatttaattataagaatgcttacattaaaatctcttggcctataaattctcatgtgagttctagttgcttgttactgcttcctttaagatctcgggggcggtgggtggttggaaactcactagatttacttccgtctttactcactgggttttggtattacttcaggtgatttgtaatctctaggccacaggaaatgggataatgtaggcttttgatgcaatggattggactttgtaaaggtgaagcttcaagctatctacttagggtgcctggggactttgaagagttatagaactatgatgcagctgcagtggcctttctgtaaatgtactactttctgttcacacatctcaccctggacctcctcttctctctagctgatactcgaaatctttaatgttctcagacctactcaacccttactctatcactttagagtaatgaccttgtgttcttcatggaagggagaaaaaaggtcattaagaattcattgtggttctgtctactgtgacaaagtttaaaaattttagaaagaataaagtgtgggctgggtgtgataactcattcttgtaatcccagcactttgggaggctgaggcgggaggattcacttgagcccaggagttcgagaccagcctgggcaacatagtgagacccctgtctctacaaaagaaaaaataataattagctgggtgtggtgacatgtgcttgtagtctcagctattcaggaggcagaggcaagagaatcccatgagttcgaggctgcagtgagctgtgattgcactgttgcactccagtctgcgtgacagagcaagaccctcttaaaaaacgaaaacaaaaaaactgtttcttaaaaaaaaaaaaaaaagaaaagaaatgcctcatgtatcagctttctacctatctatattttcattaatattcttatttttcctcctgtctcagacaaataggtgtttgttatatactgaaggccatcttgatttttttccagcaacttattccttcatgtgtctcttcaatattactcttatttctctatgttggttacatcctcttaacttataagcattccatgtttaaatcttttctgatactttatgaaccccacaacaaagcatgctacatgaggaaaaggttctttggtcagtacatttggaaaactctgcgatacaatttgggaaatggttcctacttattatggtgactactttttcaccttttgttcatcccttaattcccaatattttccctttccttttcaccattctattgaaactgtttttgataagatcgtctaactgacttttttttttttttttttttttttgagacagagtttcgcactgattcacccaggctggagtgcagtggtgcgatctcggcttactatagtgtctgcctcccaggttcaagcaattctcctatctcagcctcccaagtagctgggactacaggctgcaccaccacacccggctaattttgtatatttagtagatatagggttttgccatgttgtccaggctggtctcgaactcctgacctcaggtgatccagctgcctcagccacccaaagtactgggattacaggcgtgagccaccacacgcggcccctaactgacaaaatcaacggcattcctcttacttgccctctgctacaattgacagttgaccattcttctttttttgaaacttttattttcttagctcttagattgttattagtgggttttttttttttgtaagacttcttggcctttgtactgccctcaagaactctgccaagctctgtcattgactgttttttctttcactctttcttcatagtgctcttctgtaatctcacatgtcttcaatacttcagctccttcctagtcacatttgactcctggatacttttttcccctcctagtcctctgcactcattctattatatttctggtttcttctgaacatcttcatctccatgacataggacttaaaactcaacctgtctaaaatgaacaccaagttagggatcctccccctctcacagaggcagggcgggttcctgtaaaaaataaaaataaatgaataaaaaataaaatgaacgctgtatatttttcttcaaacctgtttttcatttacacacatctgtagacacttattcacaactatatgccaccatatatcttggttattgatatcatttggtgtctaacttgtgagctctttttgacccctcacttccttacctgccatatccttcagcaactaagatctgttgctggtttgaaattatttttactctgttagttataatgtagatccacctttaattcttgcttggattattatattgtggtgtcttagctggtttcctgcttctagtcttctttttcaaacaactacctgattgtctgatcttgcctctcatctttgtcattgggggaaaaaaggtcaaaatcccttatgaaggcatccaagctgctccttgctcttgttcctattgaactatttgtggtaccatgtagctaccatgaagagttccatgttcttgcttctcctttggctattctttttgaacattcaccttggttgatgtacccttccttctgtcttgatttagcaaacttgtcttttaagattgaattcatacatacggtcttatggcctaattaaacagcattagatgtttgctcacattgtcctagcacttaccagattctaattattcatttatagaacttatcacataaactaatatcaatatactgatcatggcacattgtagataatatatgtcttttgatacatggatgttctgagttcttgagagtgtggaattgggttcaggatacattgtatacctgtgaaatgtcagcctgtgaacttgtagaacacagtgtctatgttttatgtctttcttcctcacagcgcctagtacactgccttgcacagtgtcttttatatattaggtattcaaataattaaatggatggacctggattattgattagctggatgaatatttgacctaatgtgttcctgaaatttaatgctttacatatttttgtaaattttcccttggtacagtttcattaaataaaatatcaacgtggaaaatatttgaaaatcttaatatatgttaaaatttatgattaatatggtaggattctttgttagaaagaatacatctaagtattataaattactgtggaatatgacaaataggttttactgttatatggctatggatagaagatatgcataagtagcaataatcgtagctgtgtaaagtagttcttgcctctttggaatgttgtgatagtctcactttcctgtactacttattcactgacctaagtaaacatttttcctccttttagggacagtgatagaataaactaggtggtatgccctgtgattatgaattattactgttattggagcacttttacatgtaaataacttcagattcttttaagtacaggttcagtataccttatccaagatacttgagactataagtgtttcagattttttttttggggggtatgtttgaatccatttagtggttgagcatcttaaacctgagaagacctggcccgaaatactgcattgaacattgactttgagcatcatgtttgagctcaaaaagtttcagattttggagcatttcagatttcagattttctgattagggatacctagtttgtagcagatgcacacatccggttttatttttaagtgtcttctattctttggatacagattatctttttatatgcattgatttttttggtctgaatttaaatgtacaatccatgtgaattcttacgataattccattcagcgatgatatgcaaatgaaaaagggaatggtgtaagtggttttatgatttagaaatcttgaactttcttagaagttttttgtaaaaattatacagtggtccttctgtattctgtgggattggttctagcaacaacctcctcaccacccgcagataccaaaatactggggtgcttaaggcataatatttgcatataacctatgtgcatcctccagaatagctattacaatgtaaatgttttgtaaatagttgctatactgtattgtttttgtttgtatttttaaaattgttgttggttttttttaccccaaatattttttatctgtggttggtggaatctgcagattcagaacccatgaatacggagtgctgactgtatatactattgaaaaaaatcagatactatagaagagtacgaagaagaaggcaaaaatgtccctagccaggttaccacccacagataacttgtctgatatattttagtgaccatctttagcatgtttttacacacctgcgtgcatacgcattcccccattccctctcaggcataaggaaactattttacataaatagcaatttagtttcattgctgttctctagcttatcttttatttttactgaatcagtagtataggtgtctcttttcatgtttaataaaaatatatcaactcataatttttaatagttatacattatgatatgttccacagtccacatgaccaaatccctactggtagatattttacttatttctttttttaaaatactataataaaaaagtgctgtgctaaccttatctacttgtgtcatttttcttcttagctttaattcctagatgtgagtttgctagatcaagggcatgcttattctttgcttattcttctcccgtctcctcccgtttttctccttcctgcctgcctgcctgcctgcctttctttttcttttccccttctccttccctttttcctttctccttttaccactctggagtgcggtggcatgatcacagctcactgtagccttgatcttctgggctcaagtcatcctcctatttcagcctccagagtagctgggactacaggtgtgtgctatcatgcatggctaattgtttttaatttttagtagagatgggggtcttgctttgttgcccaggctggtcttgaactcctgagctcaagtgatcctccacccttggcctcctaaagtagtagaatgacaagtgtgagccactgcacggccttatttttcgttttgataatattatcaaactgttctcataaaaggtacaccaggagattgttagagatgtttatagtattatccatttctggcaaactttgtaaaggatgagctaacaactgtctttggaaatttacatgtctataatgtcaagctgttatgtacagagaattgctttatgctgagatcataaaaatttttgttttcctccattctaatgtaaagcttgttactaattgatcttcatttgccgggttccaacatacacatgctactttcctcttaagattgtcaagttataaataggagaacttttatttagaagaatgctaatatgaatcttttggaaatactagtaattagctttcttctgctgtctccaccaattttatctgatttagaaaattatatttcctttattgagatgcttaaatcggagggcttagtttgcttcagaaagtttataaactatattattagactaattttacaatagtcattgtatttaggtgtcacttttaacttttttttttaattaaactttgcaggttttaaataggtcagtttctgactaacccagaagttgagtatattttgataatacattttaaattggccatatttgtatgtgcttgaaataagtggaaataacaattcattaaataacaacaacaaaaaaaaccttatgtgaacctggggattcttgttaccatctgactactcctttccatctccctctgttcctctttatcctgtgttgcttgttaacactggagactagtaaaattaggtctgaattgggctgctctttaggtccatggatctcatctttattttttttgagacagggtcttgctctgtcatccaggctggagggtactggtgtagagatggctcactgcagccttcacctcctgggctcaagcagttctcctgaatagctgggaccacaggtgcgtaccaccacacctggctaatttaaaaaaatttttttttttttgtagagagagtgtctcttcttgttgcccaggctgatctcagactcttggccttgagcagtcctcccaccttggcctaccaaagttgtaggattacaggtgtgagcggccatgcctggctgggtctcatctttttatgtctttttagatcactttaacaaggcaaaaaaaattcctccaccctgtctttctttctcattattagtaccctctcttctgcttttccagataattcactgctcattgctgttgcctagtcactcccagtggcatggatagaaataattgtattggagaaatatttatgtaaaatagactgtgacttggtgcttcaaagatgtgggcattatcaaaaggacagttagttgaactgtgcgtgtgacatgatttatctttttaggaaagagattgtaaggaaagcacaacaaaacttgaaaaaccgactttataagaaagtagattgaattgctcacaagttatttgaaatggtatttgtagatcgcctctctcctagtgggtgtttaatctaaccaaaaagagttggctaaactttatatattgataaagtcaaaaaattccttaatattttcaaaacattaccactaaatttgtcttctggccaaggtgaaagaacagagattagacttacctctcttcagaaacagctaaaaaactgaacaaaaacatatgtaacagcagttttcaagacatgagatatcagacagtgaaggacagtgatccctgagagatggaaaacaaatgaggtgaaccttgtgattaacccagcttactaccttgggagagtttcccaaccttgtatagaaagggggacatcaggtggagcctgctgatctgtctgaattgaggagaccaaactggaagtccacagtggctaaggtggcaatactatacaagaaaacatactgaagaagagagagctcacatacagagagaactctggcaatttaccaagggatccctcttgaatctttagctgatgtgaattcaggatgtgaatgaagaggctaccagagctggaaaaagcagttgccaagaagatcacagtcaacaattctcagatctatacatggccaggagtagttcctgttctcactggccaacgtggaaaacttcgtaactcgtgaagcaccaagtaaggctaattggaagccatttccctcagtagtggggccaaattagccttagaataaattcttccctggttcctcctgacaaaacttaaaagcaagacctggtagaatgaaactaatttgtaagcagtttagctacaacagagagcaaaggtcaagaagatttataggaatatgaaaatatccagcacccagcagataaaagtcacattatttaccatgtaattaaaagtaccagacaggcaaaggaggaggaaagtaagacccataaagaaaagaaaatgtaatcattcaaaactgatccagaaatagttacgtgaaaacatcaacaataattattataactgtatttcatatgttgaggaagcttagaggaaagattaaacatgttagtacaggagtgaaacatatatacatagataagaaatccaaatcagactttgaaagttgaaagctatagtgtctgaaatgaataatatgtttgatgggattaatggcaatagacattgaagaacagtttagtgaacttgaaggcatagcaatagaaactgccccagaaaaccacacgcagagaaaatgtgagccatgggataacatcaggtgacctaatatccttataattggagttcctgatggggctgatgggatgtgcagaaaaagtattttaagaaataatgggcaacattttccaaacttgatgaagctgtaaacccacagactcaaggtgtccagtgaaccacaggcaaaataaacatgaagaaaattacatcaaggcacatcaaagaagcagccataccaaaaaacaaaacaaaaccatttttgaggaataacaataccattggctttccgtatccatgggttctgcattcttggattcaaccaatcatggaccgggggaagaaaaaaaacccaaacaccaaaaaaatcatactacaataaaaataatacaaataaagaatgccatataacatttatatttcattaggtataagtaatctagagatgatttaaggtatacaggagtatgcacctatatgcatagactacatacaactactaggcatttaatatgagggacttaattacctgtggattttggtatctgcagaggagctggaggatactgaaaaaccaccgtagtgatagctgatttctcactggaaataatacaaattgtagacagtataacagtatctttaaaatacaggaaggaaaaaaaagtgtcaccctagaattccatacttggaaaaaatatcctgcaaaaatgcagtcaaattgagtgcatttatgcactcagaaactggtaaaattcaaacgaggtgggcagtttagctaaaattattgcaccagtgtttactgttttgaaacgtactatggttatgtaagatgttacctgccatcaaagaaggtaaaaggtaccatttcttgtgagtctcacattatgtcaaaagaaatgtttttgaaaaaacagcaaaaaaaaaaaaaaaaaaggttgggggatacttcagactatttggtgaactctcacaacttcgtaatagaaaatttaaaaatgcattaaaagtagtcaaaaaatgtggacacttcaaagaagatataaaatggcaaataagttatttgggaaatgctaattaaaaccacaatgagataccactacacacctattagaatgtctaaaatgaaaaagaccaaccaaagtatgtattcctgagtacatagagcaacttgatctcttatacagtgctggtggatgtagtaaaatagtacagctaggctggagtatcgcttgagtggctgtagtgagcaatgatctctccagtgcactccagcctgggtgacaaagcaataccctgtctccaaaagaaaaaaaaataaaaaatcacaactactttggaaaacagtttactaacttaaaaaggttatatatacgtacgtattatatgcccaaatcattcactgctacgtttttaaccaagaataatgaaatgtgtatttgtttacaaatgaaacgtgtatttgtgtacaaagacttgtgtacaaatcttcacagcagctttatttgtaatagccaaaacttggaaacaatctaaatatctaatggatgaaaggataaacaaattatagtatattgataatgtcgaatactaataagcaatacaaatgaagtattgataggtgcagtgaagtggatcaatcttcatgctgagtgaaagaacccaatcaacttttttgcaacgagtttgccaccagaacacaggtgtcatgaaaactacccctaacagccaaaatgggaagagacttttatcaacattgtcttcattggacacatagattcaaggcaagtccaccactactggccatctgatctacaaatgtggtggaatcaacaaaagaatcattgaaaaattggaaaaggaggctgctgagatgggaaagggctccttcaagtattcctgggtcttggataaactgaaagctgagcatgaatgtggtctcactattgatatctccctgtagaaacttgagaccaacaagtactacatgacttagcattgatgccccaggacacagagacttcatcaaaaacatgattactgggacatctcaggctgactgtgctgtactgattattgctgctggtgttggtgaaattgaagctagtagctccaagaatgggcaggctggcgaccatgcccttctggcttacacactgggtgtgaaacaactaattgttggtgttaacaaaatggattccactgagccaacttacagccagaagagatatgaggaaatcattaaggaagtcagcacttatattaataaaattggctacaatcctgacacagtagcatttgtgccatttgctggttggaattgtgacaacatgctggagccaagtgctaacatgccttggttcaagggatggaaagtcacccataaagatggcagcaccagtggaaccacactgcttgaggctctggactgcatcctcccactagcttgtccaactgacaagtccttgcaccagcctctccagggtgtctacaaaattggtggtattggtactgtgtctgtggaccgagtggagactggtgttctcaaacccgttatggtggtcacctttgctccagtcaacgttacaactgaagtctattgaaatgcaccatggagctttgagtgaagctcttcttggagacattatgggcttcaatgttatgaatgtgtctgtcaaagatgttcgttgggggagtgttgctgttgacagcaaaaatgacccacgaatgaaggcagttggcctcactgctcagtgattattctgaaccattcaggctaaatcagtgctgtctatgcccttgtactgaattgccacacagcccatgttgcatccaggtttgctgagctgaaggtaaagatttattgccattttggtaataagctggaagatggccctaaattcttgaagtctggtgatgccgccattgttgatatagttcctggcaagcccatgtgtgctgagagcttctcagaccatcctcttctgagttgttttgctgttggtgatgtgagacagacagttgctgtgggtgtcatcaaagcagtggacaagaaggctgctggagctggcaaggtcaccaggtttgcccagaaatctcagaaggctaaatgaatattatccctaatacctgccactctagtcttaatcagtggtggaagaatggtctcaggactgttagtttcagttggccatttaagttaatagtaaaagactggttaaagataacaatgcatcttaaaaccttcagaaggaaaggagaatgttttgtgaactacttcatttttgttttttttcttttttcttttgcatgtggtagttttactagttttttaaatcagtacgttttaatggaaacaacttgaccgaaattctgtcgcagaattttgagacccattaaaacaaagtttagtgagaaaaaaaaaaaagccaggtaaaaaatacatatatgtgtatgacccatttatgtgaaatttttaaaaatgcagactaattcatagtgacagaaagtctcagtggtttcctggagacttgggggcagagagcagagaggggtggaaaggagagaggggtttataagaggcctgtgcagactttagtatgatgtttatggtcattatattgatttgggtaatggtttccaggttgtatatctgtgtcaagagttaccaaagttttaagtatgtgcagtgtattacatgttaattgtatcttaaataaagttgttaacaaaaagtcaccaggttaggttttcattcagaggatggaaagattactgataccaatttacagagcccttaagatagctaaagcaggccgagctctttaaagagctgtccaatagttttatgagtttactatgtgattaaaataaccctgaccagtattcaggaatattagtttctcattcatcccatcattgtatgataacaatttttttcttataggcctttttgggccatatatgcaatgaaatgttacatatcttacgttccgttatcattcaacagaaacttcttgtctttccatctaattaaaaaaaaaaaattaggccaggtgtggtggctcacgcctgtaatcccagcactttgggaggccaaggtgggcagatctcttgaggtcaggagttcgagaccagcccagccaacatggtgaaaccccatctccactaaaaacaaaaattagccgggtgcggtggcgggcgcctgtaatcccagctactctggaggctgaggcaggagaatcacttgaacccggggggcagaagttgcagtgagccgagatcacgccactgtactccagcctgggtgacagagtaaaactctgtctcaaaaaaaaaaaaaatgataataattacaacaacatttaagctaacggtcaggattcttgatttattatatttgggtctagaaggtagcagtagggatcatttttgaaagttgggggatgatgtcattttggagaactcactatataagaagcacttggttgttttggacatgaaaattggggggcaggctgggcacagtggctcacgcctgtaatctcagcactttgggaggctgaggtgggcagatcacttgaggccaggagtttgagaccaacttggccaacatgatgaaacattgcctctaccaaaaatataaaaattagccaggcttggtgacacacacctgtaatccctgctactagggtgactgaggcaggacaatcacttgaacctgcgaggcggaagttgcagtgagtgaaggttgtgccactgcactccagcctggcaacagagtgagattctgtctcaaaaaacaaaaaaaaaacaaaaaaaaaattgtggggtaaatttgagtgtatgagaatcttagactattgaatgaacattaatttttttaaaatgtccacttagaactatttaaaatataaacgtaaattagggttttaattatgaatataaatgagtgcatatctgtatattttacagaaaccaaaaatttaatattatagagaaatatctgtctttaggaaaggattattcaaacataggtcagggatagtaaaactttagttttttttatttctatttttcttatttatcccaaactccttattgttgttgaagttataatttatataactcaagttcttatgtcatctaatcctagataaaacctttgcctcctacacctgaaagaaataggttcttttctcaacaggtatttcattttaatgtgatacttgttctagttaccagtttagccttatctttcaaaaaattattcttaacatgttaaaaatatatacctatgctatttttaatagattttatagttttaaaaaaagatttatattttaaaccagtagaagttttaagaatgcatctttattgttacatgttattttaaagatttttatcatgaaaaagtattctaggtaaggtcttaatttctgatttttaatttaaatgtatctgatcattttctgatctggctacaattaatttatattatctattaaagatcttttttgtgtgctgttgtacctgaatcttacataattattttttctgccatttaaattattttatctttaatctcaagtgctcacagttgaacaaaacaaactctcaaatcaccaaatcaaggaatactaaatcaagaaaggaaggagagttttaggtcatcattttcagttcttaattcagattcattgttgagtaggttttggcatccgtggttattgaatctgtagaagttacagtgttgtatgtaactcttaatagttaggttaattttaataacttccactcgtacatatttggaggtcctttataatttgttatgaaaggtagaatggaccttcccctcttttttcccctttacagggtctcaaaaataataaaaatactctttcaaaataataaggttagagaaactcatttttgaaattagtctgttatttactgtaattataggatatatgtgaaatagaaactgggtaatacctgtttctcaggaacacactaaaagtattcatattgtgtattattttccttatgtaattttgctgtctcctggtaatcttgcgtaatcctgaagtccacgtctctaggcattttggactattttatcaagatatcaatggcttttatcttgaccctcaacttctaagatttaggtttaactgggacataccggccctgacatacttttcattctgttggtagccatttgttcccttataactaggaaggtactacgttagtaaaatgcagtggctggttttcttctccagaaatcaaggaattggccatctgtttagagaacatgccactgttttcgggaatgttatagttggaaattttttaaaaacacatttaagtcacaaaagaggatttttttcccctttggaaaatatagcctcagacctgattatactttttcagaaattcatgccttagatgtggcagtaaaagattgattctgtagttctagtgtattttaattaagcccagatttagcatttgttctatattttatcactttttatttaactttagctggcacataactgataatactcgttttggagtttacatttgggttagcctggtgacttgttaccttccagatctagtattttgaactcttaactcattcaaattaaatagggaagttgttctttctgcctcctgtggaaatttaatgtgggcaatattatatagactttttatgaatcttatgtatagtctcatatgttctagtatttcttaaagctaaaaatagcatgccacttgaatatataaagagttgtagcatagtaccactgtgaaaaaggtgttttccgtgtaatctcatagccaaatatttttcagtgtaacaagtcacgcatggtactgcatgggcattaggatcgctttagtttttcttatatcttgattcctcccatatttgccgtgtttttaaatgtttctctaacctttactttgttacttaaatacatgataccatattattagggaaatgtttgaagtacctacaaaaaagaaagtgattaattttggaagaaaggcagttttgacctttatcttggtagaagtggtttaaagatactaaacttgaaatttgttgctcagttttgaggtaatctcaacctcccagttctctaaaacttagtagtttggtaatgatgcatgcttgataataaagacaaattttacacattactgaggttaaaattctgcaaatgaaatgattaaagtcttcaaatttgatgatcagatttcctttaagaaatataattatgacacaccaaaatatggaaccgaaaacacttgttaatcctttcaataatatattttacttagtaaataaagcactgtggaatatgcctagtagattcaatgtcttttttcggcttaaagtgtgttaacttactatatttgatttttaaatagacaccaaatcctactgcaagcgagtttattcctaaaggaggatcaacctccaggctgagtaacgtgtcccagtcaaatatgtctgccttctctcaagttttctctcacccatccatgggaagccctgctactgctggattagcgccaggtaagttgagtaactatttccagtgagttccagataccatgtctgtaagcaccatttactattaatttatcagaactgaaattgtatacttgaatgattcacatttgaacattaagagctttatgttctagtttttggtaccataggccaaatgtgtagttgagaattttaaagcaaaatttaaatatgaatgaaattacatataagaatttttatatataaaactcacaaaaaaatttaaaggggaaatggttatttaggaaaaaatctatctttttgtatttctctatttttaaaactttgtgctgtttcactcaaacttacaaaggcatcagaaagaacgtgaatatttatgtacatatgcctcagagtcctccttttacattaaatttctaaaaaataatttaatcattctacatctttagatggtattccctttcagatatttgattataaatgctatagtagtaattttaaattgggtaaagtattataaacagtagtaggaaaaaaatatactacatgagggatcattgcagtagagaaaaacactttttagttatcttctgcccataatgtacccataaagtgtacccataatgacagaacaatttgggcaaatgtgcttgtactccaggagtcctgaaggcatagttcaatgtgaccctttgagaaatctatgattctttgcagtcttcatttttatcttaagaattcatgcagattttgcatctgctactccataatgtttattttagtataaaaatatttaaatttttaaaattaacatcacttatccccactgctgtataccttgatttggaaagtaaggtggtatgcacaatcacattgaattcatagtaagtgctgagcagattggtatcttatgtttgtcgaatgtttgagttgcacacacaaattaggcttctagaacctatacaggaaaatcatcacttggtcttggacattaaaaaaaaaaacagaaataaaatgaaatatatacacacactaaaacaaagccaaaggatatatctagatcagccaggaactggtactgtctccagggcttaatctaattagtaagtaaatcgttgatttaaatactcatatatctaattcaaggacctctttgggaagaaaaatgggagaagataaagataacacagtggcgcagagcatctgttttagcattaaagtatcagagtactcagagcttaataaccttgtgttgctaaggattttgtcagcgcctcatttccccaccattctttctcttactacctgtctcccttccaactcccctcccaccacttgttcccttaccttttcttctactttggtttttttccaggttcagttaaatttgtaagcattttcctttcttccctagagagcagtgtcagaattgaatatctctggtagccttaaagttttattgtaagtaatatactactatgatttttctcttgttgaggtgtgttcacattgtttacatgagcataatctgcaaatgagctacacatcttaaaatttcttaggcattgtctagacttctgagcagtgttgtaattcaactttatatgtctctttccaaagcatccgcaataatgggatccatatagcaatcagaaaactttggccttaattacatgccagtttattttgccctaacaatacttccttcctcgtatcagaaataaacattttgttaacttatttcatgaaactaatttagacatgccattcaaaaaaaattagccttttcaattggaggagttaaaaatattaaagggaattttaaatttaaaaacattcagtttaagaaaatccattaatgcttatggtataggtataagcttatttggaggtaggtatattcattggtcccaattggacctcacaatagaaacttagggtgaaattaattaatttaaaaattaaattagctgaaaatctattcttctacatagccctagcattaaatggttattctagctcctcttaacaatgaaagtgatcactctctggaaccattggaaataggtcattatatcatatgaaatgtattcttgaattctaatgactattattttaaaagtgctcttcattcagatgacaactcagttaaaatatttttcaacaatgatgaattattttgcattaattattttttctgtttggttattggtttaacactctggagatgagcaaagaaaaaatatttaagtctgcctttcggaaaaaccattgtactctcagtgtcttccatcatttcttacctacaaatgttgttttgtttaaggaagggttcttgacatttgccgtgtaaggttatagaataaataaagagtttatttacctacggtagtggtgatttagtttatttttaattcttactgtctattataggtgtaactcattgattttagttacaagtttttaatttaaagtttctatccccaaaactattgccctcgaaagtatcaaattactataaaatatgaaaccttaaatactttgacacttatgtaaactagggtaacatcattttcattacgtatgggaaagtacatatctaaatatatttttgaccaaatatatttgtcaaaatttttaggccagtttattttgtcccaatatttgagcaaagttgagtggatattaagagtgggtttcctcaaattatgaggaacaaaggcataatgcctggcacaaaggagaccctgagtgaatcacattgctttttaaaaatttgttttgatcacttaagaaaaaataagtcatgtttttggtatatgtctcaatgtaagaaataaaactttatacaaatatttgaatttactcacagctaattaggtttttaaaaagcgttaaaatttgtgacatgtatttctatcaaattgtatacacactcattttttaatttaaggaatcaaggatttatagatacagttttgttatgcatattgaacctatgaacaatagctacatttctaagtatcttttgtgaagttagttgttttaatgatactaaagatatggcacttgggcttgtctttaagaatccctccagttatgcatatttttatttataaatagacatttttctctggcaacagcttttattattctctcagaggttcacagccttccaaaatttaagaaccactgtttttttttttgttttttgttttttgtttttgagacggagttttgctcttgttgcccaggctggagtgcagtggcgcgatctctgctcactgcaacctccacctcctggagaaccactgatttaacacaacttaagactaatttccagagtgttatacagtaagaatacttttaagtaacacatagcctaaagatacatttttctagtagctctggcttaggcagagggtttttttgactagatctctggaaacgaagttatgaatgtgcttaatatatgaaataatagtttatactttaatttttgtgccatgaaaagtgatttttttttttttttttttttttttttgagacagagtctctctctgtctcccaggctggagtgcgtggctcattccaagctcggcctgccaggttcacgccattctcctgcctcagcctcgcgagtagctgggactacaggcgcccgccaccgcgcccggctaatttttttttgtatttttagtagagacagggtttcaccatgttagccaggatggtctcgatctcctgacttcgtggtctgcccgcctcggcctcccaaagtgctgggattacaggcgtgagcaaccgcgcccggccaaaaagtaattttatcgtgagaactaattgctgaatgtcctttttcatcagaattttcccgagtatttttaatagtagacatagttaactaagtcttcgtgtactttaggtttaattacctcagtgttaacaaatttacagtgtcacagtgtgtttgaaagtgactgtaagtgcagcaggagcagcacacatttctgcatggtgttcttgtgtatcatttggtggtttagtgcacagttgtgtctcaggaattgagcatctctccttctgcttaattatcatgtgtgggcccttaggaggggcagagatgagttcttatatttgcaaatgtcatcattaatttataaatgagaaaatgagtcacagtgattttcagcatttgtcaatattcattccttcaagatgaaaatagtgcagtttttttttaatcattagatatgttttcttgtaaattattattactttagagagagtgtctcactctgtcgtccatcctggaatgcagtggcatgaccgtagctcactgcagcctccagttccagctccggcgcaagcaattctcccacctcaaactcctgagtagctgggactacagatacatgccaagttaaaaaattctttttaaattttttttgtagagacgagttctcactatattttccaggctggtctcaaactagcctcaagtgatcctttctcctcagtctttcaaagtgctagaattataggggtgagccacctcactcagcctttgttgcatattattaaggcaaactcatatgattgatatggggagaatcatctaattattataccaaaattagcattattaaataattgtattcatttattaccaagtttatttattgtaggcttttgggaaaataaatccaaagaaaattatgttcttacatccagttttttaaaaatacggaaaagtcatttcttatatattcctgaggttatggtgccaaattggtgggtaaaattggctaataccctttttttaaataaacatttttagcttgagaaatatgtgagggaaaaagggaagggaaagaaaaaggggaaattaatatttgtcgttcttgttcagaaatatcaaaactttttatgaacgttgtagactaaaaatagttatttactcttataatgttgaagggttgggataagcagatcgttttcagtttaaagttctgtgccaaaaaacaaaattccgtgattgattatctctatggcatttcatatcatagatgagcaaatggaggtattaggtatttaaattacatagtagttggattaggcaataacatgatattggttattgatttaagtggaacctttgggatttacatagtccagccttgcgccaatctagaggtggcatttctgacagattgtcatctagtctctgcttagtcatttacagtaatataaggaattcattaactaaccaaggcagccagcccagtgtacattttaacaatttgaatacaaaagaaaactcagtcttctgctaaaccaaagtcttgtctctcttccatccacttgtcctagtcctctccttttttgctgaatgggaaaaaaaaactttcctatatgatagttcttttagttattttattcttcagactagttctgtgtgtgtccatataactgatttatttgtaagacagacaaggtggcgtcaggcaaccggggagaagtattattcagttcaacgaattgtataggtccaaaattgtgaactcttgtaagtcataaggaatagaacactagtgtgggtaaaattaaatccacagatatgtctacctagctatattactactttggtatccagctaaggagtgtaccattgggaaaacaggaaactctttggaaactgttctttttttggggaaacaggatgaatctatggtcttgaagatggtgaatatctaagctcagactttaaatttcattgtgcgttttagggctctacgttaagtctttcaaggcacaaaaactccataagcgattgctttagattattttgtgtttactaagtgatataattattaaaaataaaaattgtaaccatatttatatggttcttaaatatcaccagttttaataaacataacagattttccttgtaattgtttctcagaagtctactgttaaatggattctgtgggatagtcaaataattacagctcaaattaatttgatttctgtctaaattgaattcttcaaattagttttgtacttaatatcaataatggtagtttggcattaaagtatccttctaattaattaattagatttcctaaacatctcacaaattgcttaagaagaagggaccatgccatttctcatctagtacaaatttaggtataaatggtgtttaataaatgcttactcaatagataaggcttaatttttgtcttggaaaataattttgtaattgttaggtatctcttaagtacagtgaattttaattaataaacatctttgaagaacttctaaaaactgcaaatgttcaagaatatgcaggtgaatagtcaaatgaggaacagaaatgtgcctggtgaaaaagtttaacagcatcaaaactagacactgtgttttgagatgctgaagcactcttataaccaattaaagtatttgtatttttaaattgcatgtttccattctttgtaactactttgtttttcaggtatattcagcagattcattcaaatctttccaagttatttagtttggagattgctttcttcattaaaaaacaagtaaattaacaactattttatgattaagatgagggatctcaaggtttttgtgaagtggaccttttaattgccctgtaatgaggagctcatcctagaaggaagctcctctgtgtatgcatgtgtaaggacacagattgtgatgcccctgggaaatttactaacagtagaactgtagaatcataacagggttgggagtgcctgctggctatattcccttctcagttgggaatttcaggaaactgaggcgagacgtttatggcgcagagagggatgtggctgctgcagctggcttggagacctgtcaggtaaggcttaaatagctaccagtagataatattctactggttgtggaatccctggttaatgggtcctcataggtataagagttcctcttgtgaacttcctgtttaaatctcattgaattggctattttgtcccataattagggggtaggggctggatgggagtgggtagggatttcctttaactacgagttaccgatccagtgatctacagctgcagcaaagtctcttgctgctcttggactgctttcagtgtattatgactcgattgcctttagaacatggtaccagttctactgaagcagctatgtgattttcagcataccgcttggtttctgtgttttagagtcttcagttctataagaaggtaatagtagatgattttaagtctttctaatctaaaattctgtgtttttgagacatggaaatctgtagaagcatagaggacagtaaagagacagaaatgaagacagtggtgcgaagtagtaaaaagggaaggataacatttgtactagacttaagaaagattttagaaggcatatggacttcttgacttattctgtgtaaatagaaaatcttcccatggctccctttgtttcataggtggagatgaggggagttttgtttcagcaaatgtaagattagagtctggggtgaatcagagtattgtatttgttctggatgaactgagaagcagagagaacaggtgtaaatgaatgcccgagaatgtttccgatctgtttcatagctgaacgtggagagttagatgtcgatcttccttccaccttcttctttagtcaagtaggttgagagcaccagggatcattttttcttcaaccttttagctcagtgatacccagagcaatgtgcctactcagtggagaagatagtatttgtgtgaataaatttactgttctgtgtgttacatgtctagttaggagtggtcctctaattctgtaggaatgaatcagatggttgtagccccttctgtttcttgaattatcctttgattcttctcagcttgaccatgaaattcatctttttcttattcttactgcctttcagatgtagttactctagagtagggcatgtaggtagggtcttagtaaaaggagaggaattatagatgtggcctttttcaaacccccaatgcatataggcatgtaaatcctactcataaatgcctgcaacaacctagatgtggattgcatatttattatggtaataatgtttagttctaaatttttcagtcacgaatctcttacatattgatatgtctgaaataagatgttttcttaggatttcataagcacttttctatattttacatgtggttgtctagattttagcatggtatccctatacatagtaactaataactagtagtcatttggtgggggtacctttgagaaaacagtaaaattaacagtaaacaataacattaagattaaatatattaacatcctattgatgttaattagtattggtgtaaagggtgtcagtgtattcatcagctgctctctccgccatagttaatatgctgctctctcagccatagttaatataggtcataatcttattgctcactgtgtgcgaggtggtgtaagttaaactgcccaaacaaatagatccaaaatgtaatgacatggcttaatatgacaaaaatgtatttcttgcttttgtaacactccaaggcaggtgttcaggttggctaggatgctcttcacatagcttataagggacacaggggaagagcttctcagcatctctcaagtgagctagaaaggaaggggaagagcatgaaggagcaagaatgggaagatgggatgacccaagcctggaagtttctcctatgatgacttttgactaaaatctggacttaaactattttaagcagcttggctacatttcccagcctcctttagaagcaaaagtttttaacagttgatcctggttatctcatgaatatacatttgagatattttctcatttgcatcttttgtaatgactttaaaaatatcaccaaagcagctgcaataactgatttatctagcgtcaggggaaatgaatctttccagcatacttgaattttttgggtatcagaagcttacagttttaattgtcagaactttatattttccaaaatttttccatagtactctctggcttaaaacaaaatataatcttatttattgatgactcttgttcaactatatgtgcctcagtaattgtattgaaccagaatacactgactctttacatatccaagtttgtagaggagtttatttcaagttatgtgattacttagatttgttattctttccactggtcttctgctccaatgaattagttataactttttgaaggtaaggtctttctcttgcttctgagtctcttaaagtgcctgaaagtagtgccttgaatggccataatctggcaagcttactttgatcattttttttgtttttattggcttttttattggtaattctgttgtgctgtttgtgacagtgattctcaaatttcagtctaccagaatcacctagaggcttgttaaactccagcatttgcgtggttccatccccagagtttctgatttagtagctctgggtgaaccagggaagatttgcttttctgatgtgttcccaggtgttgctgatgctgctgcttgtcctgggacttcattttgagaatgactgctcgatttagaacttttgtcattcttatctcctctttcctcttaatctccctttctcatcctcctcctaatctgctgagagctaagaacacaaagatatcttttagtacctctttttttttttctttttttttaaatgagaaaaaggctttgagtcaaggacttgaattgtttcctgtgaataaggtacatgagctttatattatcctttggctgaggctagtatcacttcatttctggttaatgtctgtgttctgaataactagagttattgttgaattcatgaatataggagttgccgatgcttagtcatgaataaatctgggaaacggattccttccaccttggtaatgttagtgagacaaaatataaattagttactataacttttagtttttcaaaatacttaggaaatgagtagcataagtactgtggctgtttaaaatataaaaccctcaagcagagttccatggatggaaaaaaaaaacaaccctatggttctggaactagtaatcagatatcttttatttacatgttacactttaatatgtatgtttttaaattgttacaaaaaaatcaactaaattgttcacatgagaacatgtcctggcaaaaaaagaaagagaaaataagagaaaacaactaaattgttgttaatgttagataaataagaggcacttattgattcaaccacagttttctggagatcaactttaatttttgtttgtactttggtggtagcttttttcattggaaagaaatccaaaattaaaattacattgttaactaaatcttacttttttgtgtgaatttttgtaattaattttcataagacactcttgtctttaagtttcttgtttgtaaacaacacaacacaatttatcactatgaatgaaggacaccatttactcaaacagtcactaccactcaagaagaaaaaaatggttcttttcaaccaaaacagttatatttagtagctaacacctttcttccctctgttttgatgcttcgtttaagtaagtgttattatttaaaagattgccaccattgtagagtctagggagatcccatcattttagatcatttggccaagtttggggacaagcaggtaggttactgttttgtttcttcaaacatagagaccgaagtaagtaacctactattataggccagtgggtaagattcctactagtatagttaaaaccctgatgctggttttttaaaatatgttgaattattcatgtttttgggatttaggcactgcactttatacaatcaatagtctaatgatatttgttaaattaattaatgacagttcatctagaaatgacaccattaatacaggcaagactgaagttatgtcaaagggaagattactatgtgtagaccaggaaaacaaagtagttgtgcaggctgtgatctctatcaaatattgaggactgtgtgtttgataaagctcaggttaaattcatcatataaattgacattatgtgcctgagtttggtcaataagattaaatacattttatgagaaagctttaaggtacttaattattttgttaatgcttacagtatttctaataccagatagtcttaagtatctatcatagatagatattcagccaaaatgaagtaggattatataaattagttgatgaaattctgtagttattaaggggaaaatcagagatggaaattaagttgcaattatttgggttagatccacatggcctctattaaaggtgatttacatgtaaaaataagtctaggcaacacagcatgacctggtctcaaaacaaataaacaacaaccataggcaggtatggtggcacacacctgtagtcccagctacttgggagcttgaggcgggaggattgattgagctcaggagttcaaggctggagtgagctatgatcacacaattgatctccagcctgggcagcacagtgagaccctgtctctgaaaatgaaaataaataaataaataaatctttttagagtactttgaaatttgtcgttttattgcataatataaagagattttgtacttttaatcagttcatggtgttataattgaaatgtcactgttacgcagtcataaggtaaacatttagcacttttcctttatatttacccaaaagtgaaaaccagttcttgtttacttctcaaaaaaatgaaaaagaatactttatttgtaatatctttgtagtctcattcacagaattcctaatcccccgcaacccggaggctgtaaaaatgaggataaggggttagaaatttccaagaagtgactgttgttaagatagacattgaaggacagcaaaataagagtagaattaggtatcataaagagcatagtctttgaatccaaggttcagtttaccccgaatctagatgttggatacttcaagagtagaaaattgttctatcacatcctaaaaaactgttgttttaatggtaactattgatttgacccactttaaatgggatatattatatttgcatatagaagatgaagctctagtagcttcaacgtaaaaaaaaaaaatctttgaaatgtatgctcactttggcagcacatacgctaaaattagaacagtacagagaaaactagcatggtccctgtgcaaagatgacatccaaattcatgaagtgttctgcattataatatatttttaaaaaatttataaagattaaaaaataaaaaatttataaaatactgtattgagaatttaatttccattggcataaacacaaatgatatgcacagaattacatatacatgtattaggaatcacattaagtgtttagataagggatctgttaatttgagttcgagggtgagcaacccttatccaaaaacttttttttaaagactcccttttattatgttaggctaaaattgtaacctgttgacagaaaataacataactgtgatctatggggaaatcaggcctctatgaaaataatgatttgtgagtgtacatattcctcatcaattttacagaacaagtttttaggttagattcattataaaacatctgaatttacagattagaatactattatctttttttttcttgagtagcttaatagatatccagcatgcagattgttaaactagaatacgaaaattttaaatcagtaattctgaaaggcaaatgtattggtatagttaggaaaatcatgggtagtaacttcagatggttgcttttagtaattctttaaaaagtggaaaaaaattatgttaaaaacctcatatagaggagaagggatttttgtgatttgcttaggtgcattttttcctaatatttggaaattatgacacttttttttttttttttcaggcggagtctcactctattgcccaggctggagtgcagtggcatgatctcggctcactgcaaccttggcctcctgggctcaagcgattctcctgcctcagcctcctgagtagccgggattacaggcgtgtaccaccacacccggctaacttttgtatttttagtagagatggggtttcaccatgttggccaggctggtctcagactcctgaccccaagtgatctgcccacctcggcctcccaaagtgttgggattacaggcatgagccaccatgaccggcctggaaattaagacattcttattagaattgtggcttattttgtttggaggaaaagtatattgtgtagctgtgtgcatttttttatgttgcaaattaattttgtgtttgaacatttattccttgaggaagctttagaggtacctcaggatgtcataaaatcagtgtagaaattaaaaaggcttttataatttcactggcaaatatcaggtttatagtctttctaaaatctaatctccctgatgttttccctttgtatttctgtaaaaagaatatagttccatttatttcatcagaaattctgttttattgcattaacattgatttcatgttaatcttttaaaaattaaccaaagatgtgtatcagcatttcccaaggtgcttttaaaatatacattgctggccaggacccctaaacctaccaatccagtttctcatccagacctccatttttcttttctttcagttctataaatgtctttttttagaaagcctttcaggtattgtgatgtcaatcctatttaagaaccagtgccttaagagagttgaggcagttaagaagcactagtgtggtctggtacagtcagggagaacaggcttcccccttcctcttactttcagttccatgtgggttttgttgttgttattttaagaggcagggtcttgctctcttttccaggttggaatgcagtggagtgatcataattcattgcggccttgaattc

SEQ ID NO: 29 - DNA, 1348 bp, Homo sapiens
caggtggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaac

SEQ ID NO: 30 - DNA, 6430 bp, Homo sapiens
ccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatcctt

SEQ ID NO: 31 - DNA, 1226 bp, Homo sapiens
ctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgacccggtgaccgggagccccctgacccaggaacagttcatccccaacttggctatgaaggaggttattgacgcattcatctctgagaatggctgggtggaggactactgaggttccctgccctacctggcgtcctggtccaggggagccctgggcagaagcccccggcccctaaacatagtttatgtttttggccaccccgaccgcttcccccaagttctgctgttggactctggactgtttcccctctcagcatcgcttttgctgggccgtgattgtcccctttgtgggctggaaaagcaggtgagggtgggctgggctgaggccattgccgccactatctgtgtaataaaatccgtgagcacgaaa

SEQ ID NO: 32 - DNA, 171582 bp, Homo sapiens
gaattcccaattcaggatcattttgggtgcatgtagacaagaattaattgcattttgctgtggctcttgagatgttttttgtaataaaatagtaaaaacagagaaggtaaaccaaacacttagactgacagagaggtaaggagtattaaaaacaacattcaaaatttgacaacattcaaaaccccccaccatttgttaatttagttacttatgggcactctgacatatgcccttctctcttttgtatgctgaagagcaacacattattttacttaattctttgcaacaatccttgaaaatgtggtaagattcttggtggcagagagaaccaagtctcctaatggctggcttggggggaaaaaaacctctcaagcatatggagacatctagaaaaagatgtgcatcgtcagctgtgattccattgtgtgctctcagactggatctgagcttccttcctcctgggaatttcagtcttaaacagaggagttctttgacttttagatgtcagtatactgaagcaggagggtagaaaaggagctcaccaattacggatttattatgttttgagtagttaatatgttttggattttaacccttcattggttaaatataatttagatgagtggcttagtgttagaagagcattttattggaaatataaaatgtaaggcttggagggggatttgggctgtggataaaggggtaatgctccttagttgtctttatttatagttgtatcttattaaagctttccaagcttcagtaacatcaaggatctgtgagcagtccttccattatatgccctgtatttaaggattcagtaccgtagctgtttcaaattacataaggttgaaatgtgacccataagttgacagcttggatttcttaggaaaaattgtttgtgttgtattgagttgaaaagcaattctttaagcactctttaggatattggatagtaaaggaaaatacaaaaggggatggtctctttaaacaatttttctgaaatgcacagcatgtgccctcatttgatattttggccattattgtgtcatgatcgaagttatatttaaaagccaagttaatgcttatttattgttatgaaaaaactgctatttaagaaattactaactttagtattttgcgtatgtagttttgtttagtaatgtatgttattacatgctttattgattttagattaagagaataggagggagaaaataagtcactgctttaaggtattggtcttttattgcagcaaatcataaaatcagcaacaaatcaggatctttttccatagtataagaataagactatagttcataccaaaaatgaaagccatttaagggaaaatggaacaaaaccttcagtttttttgtaccctttcatatttaaggctaattttacctctctatgccttacttttctaaacaaacaaaaaaggttctaagtgtttgtgttctaggtgtttgtgtttttccttttttgtttttaaaggcttctagtagggctttatgaattgcaagctgtaaaaagaatatgtcatattactctctaaagtctattacaagtaatggctggaaaagctatgaaatacaattttaatgttgcagaccttcaattcagacatcataaagaaaacacatctttatggattctagatgctaatttctagatagaggtgatcacgaatgtgacttttgtgggtattttagaagctggtgtagttctcttagctgtggtaaaacattatgaaaaggagtggaaatcttaaggataaactatgaaggcaactgaaattaaaagactaggtggtctgtaggtagatcctaatactgttagcttttagggcaaagattttatgtgtttactctatgaaatgttgatcaatgaccacatttctgggtccccatggctgtgatgacataatgcaattgtggaaatgttgattccaggataattttcagttggttctctggttggaaatttctagagaagaattaaatgacaagggaacctatggtggtgttttacatagctgtttttgaggctttggacacagaatcatataggtagaagttactcgcaactggttaaatgttctaaaggaaaaagaaaacatctttactttgactaggcgtcagctgacagataacgtggagaattgaaattagcctgttaattctggcagaatttatgctttgtaggcagccagttccgaattgtttgagttcccctggccaacttaaatcttactttggtcttgctgttgttgttattattattattattttgagatatggtctcgctctgtcatccaggctggagtgcagtgacatgatcacagctcactgtatagccttgacctcctaggctcaagtgatcctcctgacccagcctcccaagtagttgggactacaggtgtgtgtctccacgcctagctaatttttgatattttttgtagagatgaggcttgcgatgttgccccaggctggacttaaactcctgggctcaggcgatcctctccccttggcttcccaaagtgctgggattaaaagcattagccaccgtacctggccatcattttgggctttttggaccttgtgtttgccttcttgtctgactttactattgcttcattcattttatcgtttagtcgtttgatgagtactgtgtcctggccttttcagtgtactttgatagtataaaccatccattacagagccagtaattaaagggggaacatagagtgggtgatcactttttttggttggggaggtgggaggggacatatatgccttaatttcaatttgctttagtactaaagatctgttctttttgtgtgtatgtaattttaattatataatgtcagcacattgtgctttgatttgggtttgggttgtcttttccctgaaaatggggttgaaatgtttataataaaaaatattgtaaaatgtccccttaactgattagcttacaaccgaatagatttcatgtaatgaaggtatgaatatttataattctttttgttttatttcctctggaatcatgttttgtgctctctgtccttgagtcctgtgtggtgtatggtaaggatggcactctttagttgggcgaaggtgataggcgttgcctgtgtattgttgctgctttaggactactcattttgggccttaactacctaggtttctaaaggatggaatgctcctgagtgcagccttgtgcaagtattctgctatggttgtcagtttttctagatgtagcttgttcttgctctttttttttttttttttcctttttttgagacagggtctcactctgttacccaggttggagtgcagtggtgtgatctcagctcactgcaacctctgcctcccgggttcaagcgattctctcacctaagcctcctgagtagttgggactgccgtcacatgtcaccactcccagataatttttgtattttttggtagagatgaggtttcaccatgttggccaggctggtcctgaactcctgacctcctgcctgcctcagcctcacagagtgctaagattacaggcatgagctattgcacctggcccattcttgctcttgactaaaaggtctgtattagaagagtaacaatgataacataaatgataatagcagctatcattgagtgccaggaacctgatacaggcttttttgatgtgtgcttcattctttaattcttgccacaaccctataaaatagaggttacctccattttccagaaggaggctgaagcttaaagtgagtttaagtcctgtgcctgtgagcaaaactttggcgaggaaaaattaactttgccactaagtgggggaaataaataataaacatcagagggaatggttgaatctgaaaaagtctttcttttaggaatctgataaagcaaatgtttgtgggacattataaggctcagtctacttgttaagtccgtaagaaggatgaatagatttgaatagttccagtcctgcaaattgtatcaggaggcatcttccagactgttgccttaaggagggcttatacctgcacagaggttatttattttaagacccatgaatagtctctagcttttttagtcatcagctcagtttttaactattcttgaaattatagattttttcttttaattttcaggaaataagaattatatgggtgaagtaaaatagttaacatttattgagtgcttactgaaaaccaagtgcagggcaaagatgaccgtacagtactcttgtatgtttcttactgtagcattgagaggtagaaccctgttcttgttagctctcttacccagtgctttattgaagtaacatagatcagtaattctctgctagtgaaaaggaaaagagtagggagtgtattttgcaagagcatattcaggttgcctgttgttctcacaataaaaagctcagaaaataaagctcaagaaaacttgattgtgggggataggtagaacatagattgacagagcactatagaggatataggcttagaaaggatagaatgctgatacaggtatttggcttcttatgcccttaaaacatttaattctagtattgtttaactgttgtgcgcagattgtgtgatgcatgttttgcagatgttttgtaatcatgtagcatggatgactaggtgttgaggtattgtagtcccaaaaagaaggctgataatatattcagtcatctgacttctgctctgctatttgtggaattcttctgtctgctcaattgtttgcacggagcgcggagagctttcagggaactctttcacctgcacatataggatcagcatgcattgcttacagtgttccagctgctgagactgaagacctgttgtcatcgacgagaatataatgcacggtattttctattattcatttagtgtgtccatatgaaatatgacccaaaacctttcaaggcttaacttggagagtgttagttctggtagttcctgttggtgctgactgatctctgcccattgaagtccccgtctaaatgaggattgtctttactagcagatcattcctgcttataaaatcagtacatgatttaaatatgaaacaatttcccttgtctttggtattgtagtagcatttgtcagaatatttaatattaacttatcttaaaatttctaattgtactgttaatatgcttaaaaaggaaaagctttcagttattgtcgaaatgtttttagattcctaaataaggaatacggaaattccgtagtagaattgaatgtcgggagtatatgaatttctacaaatttaacctaatattacagcatttctggaaattacagaagcaggttgtagttatggagacaggcattgggggcttgccggtgcttgaggcggttctgctgtcctgcatctgccatcttgtgccagcagcctgttctggatgtagcatagggtgtgcctggcattaagaccagactccagtagctgaccacttactacgcagtgctttgacatcagggtggaatgataaataatgattcaaacttctgaccacttcactttgggtatgaacctttgcacatctttctcctctacctccttttatctttcttcttccctgactttaattttttcttcaagttgaagattaaatataagtggtagtgaaaagaatacaatcaagattacgggggaagtctgttactatcattaaggatttcatgtatgtagatcatgtctgatcatgatctacagtttcccctttaccaaacagatttactctgccaaaaacacttagtgaagaagtcagctgtttgttaagaaagcagttatgttgtgcctgtgttaagatcgcttaacccaagagtggtgaggtattggctgatttgttgttggagttagttgctggacaacattgtggttcagaagactggggctgagcttctattgtagtaggatcgagtattacattccttagcttttatatctgtattttattttttccctgtttaaggatattgttataaaccctacagtgttagatgtcatgaaaatggtgattaaagccatcaaaatggtgttagctgaaaatattaagacaatttaagattggtgaaaactgtagtcaaattgctaaaacttgaagaatgcctgcctctttggagtttctcaatatattttcaacttccgtaattctattttgagacttattttgtgtggtgttcttgttactgttttaagtaatattaatgttttgattccttaaagctttttcatacaagtgtgatgtaaaaatatttatttcatttcaacatgttattttggccaggcgcggtgactcacgcgtgtaatcccagcactttgggaggccgaggtgggcggatcacctgaggtcaggagttggagaccagcctgaccaacatggagaaaccccatctcagttaaaaatacaaaattagccgggcatggtggcgggcacctgtaatcccagctgcttgggaggctgaggcaggagaattgcttgaacccaggaggcggaggttgtggtgagccaagattgcgccatcgcactccagcctgggcaacaagagtgaaactctgtctcagaaacaaaaacatgttattttattatatttgagcaccactgtactcttttctaaataggcagtacgtcatgaaacctagtgaaggaaatgggaaaccacatgactatcttttccttatactgtgctactttttattttaagcaaagggttgtacaatcaattaacgatcctaatagaatggaatattctaagctattacatgtaataccaaaaaatgacatattcgctgactgaacttactgacagtgaacaacaacaatagaagtcaacaaaatgcctggacgttgaagggcattggaaaacaaaactggagcattatttcctggttaaaggacactcatgcaatcaatagcagcattctcacgatcgtttattatctcatttctagtattaagtattttcactttaagaaaacacatttagcggagaagagaaccaggagacaaggggagcccagattttaggctccagggaagcaaaggcttgggcaggaaggaactgggcctgggcacacctggcctggccctacatgtgggtttcagggtgatctgagactcttgcaggcgtcatgaactgggagtcactaggagaggcctcagctgttccctgcctcctctcactgtgtgtatgggtgggggtggaggatgttgggggccagctgctgacctttggtggggagggaagaagagaggaaaagagggagcctttggtaggtagatagaggatgggacaagtctcagcaggtggaggccctagatgctcacttgcactacaattgtacaattcaggatatcccaccaggagctcatgtatagagagagccgtttaatccgaatccttaattgtggaacagaatggcaatgctgatggcctgtgcccttcaagcaccactaagccccaaagctcttctgccctcatcctctgtgttaccagactgagcatttgggggattgttttccccttcttaggacagaagtgatcttggatctgcacccaagatcagataaagagtaggtagtcctaaggcaagggaaggctttctggggcttgtggttttcagaggctgagttccctgtcttcactgggcttgtgtacctctagggcccttggaaggagtgaggggaggcaatgtcttcccaccgaggggtaaagagagttttccctttcccatctccttcctatttccttttgaggttcaggtatccctgggagcttaatcccacattttctgggactaccacaggttttcatagatgtttactcctttaaggcagtcctctaaccttcaaatcagaaacaataaagaattaaatttttggctttgtcacttcagtaaaattggacatttttcacacctggacttattaaattttcccctgcagaatattttgccactggagtgagaagagggattaatagtatcagtttttagtggatagaggaggaaaaggtaaagaaaaccttggggaaattcagtagttctgaaaaggtaataaaacaaaaccaaatacaaagaaagtataccagggttggcacttaactatttccattgaagaagtgataaaaaaagagaatgaaggcatcacttaagggctgatgtcttaatagataaataatgaaattctacaactatccaaggagcaaagaccttccagttcacacattaatatatacttgtggcaacacttgtaaaaatgttctcaacgttcttcccaaatttctccttttaataataatttcttattttgtgggatgtttttatttgcagaataagtcagaaggctatccatctgtctgtcatttattcattttctgccaccaaccaatgaacgttaaatcgtagaaacactgtgcgactcagatggaaaagtgggcggcgctttgtgcagtgtcctgttgccctcctagctcccctgatcctttaataatgtggtagaatgagaggctaaatactgttatttcagtgtgttcttgttttcagttcctgacaaaaaaacctgctagaaaagtattggggtttagggaggactaaggatttctttggtcccaactttctttatgaaaaatttcctacacacaggttgaaaaatagtacagtgaatccctgtataaattttgctataaatgtttttaatttctcctcctaccctctccacggtgtggttgtgagtatgtatattggataaaccatttcaaagtaaattacagatatgattcttcatccataaagtgcattgtcttaaaatcaaggcattatcttaggtaaccacacacacagtaccattattaaacctaagagaactaatatcatctaatatcagctctatttcagtttttcaagctgtccccaaaatggctgttacagctttgtttttcaaacgaggatctaatcaagtttactcattgcattttgttctctccctttcatctcttttaaggtggaccagttcccgtggtttgttttgtttgtttagactttttagagtctaagccagttgtcctgaagaggatgcaattgttctatcaattttggggtgtcagacttcagtttctccagaactgttaggaaattaagttgttaatgtgttactgagtttgatcagggctgaagaagcacagccaacctttgagagcttattgcttgaaatgatggcatccttggaccttttcatggcatgttccttctgaagtctctaggtctgggcctagacaaactttctactggcagatcataaggagatgcaaatgaagaggtagtatctgaccatgagacatttaccgtctaacaacttgagatattttttccctcctgggaagtagatttctgttttaggctcagattaaggagggggatagaaattgagacacttaattttacagcccccttggctaaatagaaagcttttattcaaacacttatttggagtaacattatggagacgaaaatttcctggagcttttcggagcaatagtaacttcagtttcttgaatacttgactacttcataactttgaatttggaagtttctgtttctctcttctgtttttctttgcaatgtcttcatctgttctccctgttgacttttcctgtcctataattatttccatcttctttactttatacctaaccttaccttttctctttcctactttaggatcttattagaagtgtggtagagccctctcttccctcttggatcacagtgtgcataggggttcattctcactttgagaaatagaccataaatgtaaaaatcattcataggtatgtagtagacaccagagagaggtacctggtcagtctcactcacctaatccagtggagaagtagtagtagtaatattcttcatatgtatgtgtgtgtgtatgtatgtatgtatgtatttatttattattgttgttttagagacagggtcttgctctgtagcccaggctggggtacagtggcacggatcatagctcactgcagcctcaaactcctgggctcaagtgatcctctcacctctgcctcctgagtagctgggaccacaggtgtgcgccactatgtccgactaattttttttttttttctctatagagatagggcttgctatgttgcccaggctggtcttggactgggctcaagtgatccttgtgccttggcctcccaaaatgctgggattataggtgtgaggcactgtgcctggcctcataattatattcttaattgtagatagaaaaaccttggtgtaagagtagtgggcaggaaagattttgtcacccaagaaaacaataagaattatcacaagcatttgaataactccagaaaaacacttggcttgaaacttttaagctttggaaaaagcaaaacacaatgaagttatctcctctgactcaaagtaagtcctcttagagtcattgttaggctaatggccttgaatcaggccctgcacttttctgaatgggacatagagacctagacaacatctcccaaccccaggatagaaaatgctgcttaaaaataatgcagatattattttgtggaattaatatttaaaactgggaagtcatatacttagaagatagaaaaaagaatggaaagaaaagtgacactggtcatagaccttttttgtttaacaaatctgggcaattttaaggtgactatgaacttgaaataatatgtgactcggatttttatttttattttttgtaaacattttcctgaaatggccggatatggtggctcatggctgtaatcccagcactttgggaggccgaggtgggcagatcacctgaggtcaggagttcgagaccagcccacccaacatggtgaaaccccatctctactgaaaatacaaaaatgagctgggtgcggtgggcacctgtaatcccagctactcgggaggctgaggcaggagaatcgcatgaacctgggaggcagaggttgcagtgagctgagattgcaccattgcactccagcctgggcaacaagagcaaaactccgccgtctaaaaaaaagttttcctgaaatgtcttacagacatacttgatgacattctccttgttcttgtcattctgtatgtattgtgctgcttttaaaaaaatgttggcgttggccaggcatggtggctcatgcctgtaatcccagcactttgggaggctggggcgggcagatcacctgaggtcgggagttcgagaccagcctgaccaacatggagaaccctcatctctactaaagattcaaaattagccaggtgtggtggcgcatgcctgtaatcccagctactccggaggctgaggcaggagaatcgcttgaaccccagaggcggaggttgcggtgagctgagatggtgccattgcactccagtctgggcaataagagcgaaactgcgtctcaaaaaaaaaaaaaatttggcctgttggagggagtttgccaaaatattggagttgcacactgagtggctctgctacaacccaaacagatgtgatagtagcttgggtcagttgggaggaaaatacttaaatagtctgaagtgtaacgaaaacagggacattaaaaacaagggggaacaacaaaaatagtataaagacagtgatattattgtaaaacagtaactatataaaacccccagaaaatgagatctcttgcttggttctgttttttattcctttaaaaggcacctccaattttaaaagtagtcacttaggagaaatacttataaaatgagtagtatttccctctttactaaacttacttgaaatgtgcaaaaattcactgagatctatgagatcttttaagatactgacctgtctctctccactaagtaattgtaaactgtagaccctacactaaagaattctaggcttttacttagtttcatctttgttccctgagacctctttctgtctgcgtgtgtgtgtgtgcgtgtgtgctttttaaaaagaacagttcatttcctcttttctaatattctgtgttttatctgctgtggatttggaaatcagataaccaggtttgtttgtttattcagcaaaaatttaatgagtgactcgtatattgcagacactagtatacaaagattaaaaaagaaatgttcctatcctcgaagaccttacgcttagggaaggcaaaagccatgtagacaaataattattgtataatatatacattagaataaaaaattgtattagagtggagggctatacagatatgttacgtgagcaaactgcattttgcaaggtgaaggaaggcctcagagctgctgtagtgtttgatttgagccttaaagaccggcctagatgagatttcatcagggaaaaggaatcctaaagaggcctatgcataggatgaagacagaaaatattatagtatgtttctatttttcctcattttacatatacctttaataagagctgcatgataatttgagagacttatcaataaagctagtgatctttagtgcacagaatgtggaatatttattttgaatatagggaaagcagccttaaattctttgcttccttttcagttttttccttgagttctgaatcagggagttctatttactattgctgcattatataccatcccaaacttggtggcgttatgctcacaaatgttgtggctcagaatcataaaaggtatgattgacacagcttatctgccccatgatgtctggcacctcagctaggaagacgcaaagccagggctgagtctatgactggggagctggaatcagctgaagccttgctcacctgcatgcctggcctttcctactggctgttggctgggatgtaggctaggttgcaggctagaatatctacaaattggactctccttgtacctgcttggacttcctcacagcatggcggcagaagttcagtggatgaaaattccaaggaagctgtgttccctttatgacttaacctcaaaagttacataggatcacatatgcccttagtcccaagctgcccccccgccctccccctctatcccccatccagattcatcagagaggaagccttgattccagctgtacttcagaggaattcagcagggaggaagcattgattccagctgtacttggaagacacattataagaggagcatgtgggataagagattgcagtcgtgttgggagccaccatctgtctgtcacaggctaatttgtagaaagttgaagcgttactgtcctttcctttaaaataagagaggaaagaggatttattatttctgagacgtatgaagtgattcaatatgagatataatgaccagatgttctttagtttacaaaagagagcattcttaaactatatctaaagggattttagacagacatttagaagaactttctgatattgccaacatggcagggtggtgcatacccaaagccccagctactcaggaggctgagtcaggaggactgcttgagcccaggagtttgaggctacagtgtgttatatgaatagccactgtactgcagcctgacaacatagcaagactctgtctacagtaggtaaataatttttcaaaaagtttataggcttttttcttgactagaggacatttgtatgatttaaaagaaagtttaccagaccgggcgttaaagcgagaccccatctctaccaaaaataaaagaaaaattaacccagctacttgggaggctgaggtgggagaattgcatgagtccaggagtttgagcttgcagtaagccatgatcatgccactgcactctagcctgggcgacagagtcagactcccatctcttaaaaaaaaactaaaaatattaaaaaaggaagtttaataatggttaagtatactgcctctggatggacctgttgcattggacaagtgctttatttctgagtcccaaatttcctttttgttggatggggataataacacttgagttgctgctgagcatcaaatagaagatttttgttattcatgaagccagaatgaattagatgattttaaagaagtcttctgggattggattctctggttatcactaaggaagattgaacggcattagttaattttttaaaaatttttctttacattctagaattatcttttttaataaagaaaaagtatggcccctctctattgtttcttctcatatacagtgtgtagaactcttgattaaatgacgatgacatgtattttttggactgtttattttaccacaagcgtttccagggagttagccctgaaagccacttataagtaataatgaacacagttctccctgaaagcactagaatgatgctgcttccccagatgatccattttgtagattaaggcagccttttgtaaaaagatgcagggctttttacatggtgagagcatggatgatagaacaagtctctcatccaagagtctatacatttattttagagtatataaattatctactttgcttatcaaagtggtagttccaagatctcattcactgagatttataaaagtatggatgcatctagaaatctgtttgtaattttaaagagagttttcaagtgacttttgatagatatagtggggaacagtacttgaagatccctttgtctggtcctaagcacagagggtcatggaatcctctttcccataaggaatcctggtaacctgagaagtgtggagattactggcaagactgtccatcagtctgcacgtactgtttgggctcactcttgcgtattaagaaatttctcaatagcagaaagagaagaaaaccgtgcactaaagtaactaatgtgtgttttgtgtaccacaagttacacacaaatgcctcagaaaaggcatttcaattctaaggataaaatgaaagtaaaatatttcaagatactatgattagttttttttttcctcatcactcttacaaggtgatgcctaaaaggcagaaaaattgtaaaatttgtggaacattctattggaatatgttaagtacctgcaaaatttggaggtcttggctgggtgcagtggctcatgcctgtaatcccagcattttggaaggccaaggtggaagggtcacatgaggccaggagttgaaaccagcctgcccaacatagtgagaccccatttctacaagaaattaacaaaattagctgggtgaggtggcgggcacctgtagttctagctactcaggaggctgaggtgggaagagtgcttgagccaggagttgtggctgcagtgagctatgatgacaccactgcactctaggctgggtgacagagggagactctgtttcaaaaaataaaataaaattggagtttcttgaatacaagagtatttgtttttcagttctgtgaaggcagtttggtgtagcactgtctggattgccatccaactccatcacttaaacaagtgtgaccttgcgccccaatttttgtaaatgttcgctgttgttattgtcactttgaatcacctgcagtgataggtatttgacatacagttggtgttcaataaatcttggttagttatttggtattataattcagagtagattattttaaattcaaatagaggatgtttagaagaactatgaaaaaagttagtcttgaagacaagacccacctgtgcattcaggattatttatggtcaggtttttatggtccttctttatcaattgaagggtgtaacagaaatgcaatgggtgatgcagcactctgtagtccataaggatacattatgaattattttctaattattcactgtttagagtaactgtgtttctactttgtttgtttacagaatgattattattacaatcccttaacattttagcacttggtaggtctgattcaatggttctcaatggatgggagtggggaaggacaaagatgatctgatgtatcatttggcttaccaacattcctgtccctgttacattcctgtggtttcatggtggttgaaggtgaacctgacagtgctgttttacagagaagattgaagggaaggtgttttaagtcaatagagttaaagctctttatgttttggaaaaaatttgggggttattttaaaaactactcagaggtgatagagtattgtaattatcatatggaaaataatccaagaaatatagtatataaaattcacatttcattaacctggaaaattgactgattgtttgatgtatctaagtgttggacttagaagtggacagtattatattctcgacaaagagattatatttagatttctcagagaagtgtgtaatgattaaactcaatgttggaaccatttggttaatttaattataatttaaaataaaaccccttttgagaaaattcctgcataagacttaagtgttatttttgactagttcagactgtggcttaatatacaataattttctcagaaaaatgaagctcttgcgaagaatggttgggcatatttcaccaaaatcaagtatttgtgtgtgtgttttttttttttggagtttgaatataatcctgtaagtagatgcttcaaaaccacttgaatcaccatggaaagcaaatctctttagttattctccatctaagcagcctttgccgtacagtttaattaaatctaatcatcagtaatagttctcttttccatagggataagttggttctttgggtttttcaagatttggcctgtttcaaagataaattcacattttacagaggtttgcccatggttatacacaaatggagtacactgatgttctcagaggtgatggaaaacttggtatagctaaattccctgatggaaaatttccagatccacagggaaaggtgagatatttagatacagttaccagagaagactatttataagctctgtttatgaagttcaaaggaataaactttttttttcttagaagtatgagtagagcattcaaatagcaataaagaaaatttctaggccaggcacggtggctcacgcctgtaatctcaacactttgggaggccgaggtgggcggatcacctgaggtcaggagtttgagaccagcttgaccaacatggagaaaccctgtctctactaaaaatacaaaattagccaggtgtggtggtgtatgcctgtaatcccagctactcgggaggctgaggcaggagaatcgcttgaacccaggaggcagaggttgcagtgagctgagatcatgccattgcactccagcctgggcagcaagagcgaaactctgtctcagaaaaacaaaaacaaaaacaaaaaaaactaggatgattttagtgtccctcttctgtaagaacataaccatttaaaatgttggatttcaagtattccaatttaaacatgatttataaatctcagtaacactgcataggttagaccaataacttctagtaaaacttctgacagtgtgtctgtcttaaatgagtaattataggtcaagggattaaacaaaaggaggtaattcctggtccagctcctccttggtgaggtgttttcctcttagatctggttgctgtacattcacacaggcgataacacagccccatccactatctagccctggccttcatatcccagcttcttggtgtcttgataggacttctctggaagcgcgtacctgtgtgcacgaacatctgaaggaaaggtgtgctctgggcgctctgtccagagttcaccctttcaggtagatgcctctgcagtgggtatgaaaattgactttctaccattttctgtaatttttcgtatttgtttttaatcttgaaataggaacatttattagtaagtcaaatgagctattcactcagagctgtggaaactgcagagtaccatctgtgtagtttgtgatgtgccatatcaactcatatttgagcttttagcaggaaaagtgacataaaattgcgaagtattattattaacacggctgatcctacagtgaatcagggtgaggaaagaatctctgtggtacagactgcttttccatatcggttgtattaacccttctggaacgcgtgcaagcatttggtaattttaccaattggtacccaccaattgatcatcttggttatgtcaagaaagaaatgcctccatgttctgacttggatcagattcatttttacaaattataattttcattcaaaatagatatctactagcttccctccctggttcttctggaattcctgaacaacaatgcctaatagctgctgtttgtatctagataaaactgttggtggacctggtgcaacagatattcaaactttcccaacatggaatattagtctttcctgactttatcacattggggccaagatttctttgttctctttcttccttgtggaaacgacattttaaatgtaagccttacactatgctaaacaaccctttattctagccagtttatttattattgccagtttctttattgggaaaagtgatcttcgaagtcaaaaagccgtctgcctgcttgtgtcaggtgggcctcctcctggcctcggggcactgacttttcttagaagaagccttttttagcagcttcggccctcagcactctcctctcctgatcctaactggtgcttatttcccagaccatatgttggctgttaaccttacgatagcttattttatattctggctttttctgtatgtatttaggttttatgctgctaacaaaatgataaactccttcagtggcagcagcagcctgggatagtggaaagtgaaaagaatttggatttagaggatgatttggtatcagtctcgctcctctatccctgagttggaagcacaggcaaattctaaaacatattctttaaaagtagtctcatgtaataatacctgactcacaggattttgtgcattttataatctatatagattaaatgctttttacctataaaatgccattacggatattatttattgtggttgtgagcacatgggtaagccacccagtacctggatcagattttacatgagagcttcagaggttcttgggaaatgtcaagtaaaatgtgttatattttcaaaacctattagctttgttccctctgctgcatacttcattatctcaggtttagtcttgtatttctgttatcatctctatataagcttgaataacaaaagaaatattattattttacatttggtaattatatggtgtcactacaacaatcccaattcacctgctaggctggaaaagaaacatacttttccatgattaatattagtgcttatgtagcattagtattataccttcgtagggttccctgtaataacttttatcacagagtcctaatacatttttcattgagagagattagcactactgccttcactttaacaaacgagccatttgaaacaatggaaacttgatatttataatcgagttaagattaggatttaggatcccattgtgtattaaatagaagttacattttaatattctgttgttattacgctgtttttctgtgcggcttcctgaaattcctaaaagttaaagtttttggtattggcaaaatatccctttacaaatggttacaaaaaattactatggaaaagtttaataataataatgtaatgaacgcccatgaaccggtcatctatacctttatctattactcccccatctgttttgaggcaagtcccagatacatcttttcatcctataggcatttttttttttttttgagacagtgtcttgctcagttgcccagggtggagtgcagttgtgccatctccactcactgcaactcaacctcctggactcaggtgatcctcctacctcatcccaagtagtcgggaccacaggcgggcaccaccacacctggttaattttttatattttttgtagaggtgggtttttgccatgttgcccaagctgatcttgaactcctgaactcaagtcatctgcctaacttggcctccgaaagtgctgggattacagacgggagccacggccacaggcctttttttttcttttttaaagaagaaaatttcgtgtggtatatatgaattaacaaatgctcactcgaacaaaattttgggctgtatagtccttgaaaatttttgttccgtggtagcgtaataatagtgcaattaggcttggagaatgagggctgtacagaatgaataccagtaacaggcatatagtctaggggagagaaacattaataaacacacacagttctaagctctgtgacagcagaaatcttttttgccttgcacagtgtctgaaacaacgtaaatgctaagcagtttgttgagtgaatgaaaaaaattagtagaaagtggaattcttgggaacatgagtcttgttatttgtgttcagtgtcatttgggatttaaagtatgtgtgtgtgtgagtgagtgagtgtggcactgtgcgagtgaggagtatgaattaagaatttgccttgacagagaatttaggtttgccctaaaactgagttctgaaacctagtaggatctcatcttacaaaagtattatgaagtgcataggtaaatggaaagtaattcatgcagctctactaaatgaaacagaatgaaatgtaattttagaacttgtacatataattaattattcattctttaggctgaagttgacttatggcattactgatatttattttctttctttccttttacattaagaacctgcttgacacttgtttcctgtcttatttatagaaggcttaagctgtatgttaattactcatgtttgcatattcagagcacttagaactaatccgactgccttttttttgagcctcattaagttatttataaagttcatactcattgacacctttatatccttcagtgggaaatttaatgtgagaaaacagcatttcagtttataatcagccatgcgtcatttttgtatgagttttagttgatgcaaactggtagttaaagcatgatacagaaacgatagaatcagaagtttagttgctctaaattttatgtataggataaggacaagactctgtttttgctactaatatatattttttaaatttttaaaaaaatctcaatcctgcttcttctatagctacttatcttaatatgtaatatattaaaattttgaatgggcaaaaagatgacttttttctcttcgggtgtgctttgtataagcagtaaatgcagttcatttttcccagatactgtctttgataaaataaaatggtggcagaaagagataaaatgtcagtgacaacatgaactgctgatatgtggaagacaggcagtccgatgcctccatcacacagcagtgcatttgtctggaccaattcgtggaaaaggcagaagtctgctagggaactgaaaagattgtatgaaaccacatgatattaaatctttattagggatcttgaaaggtttgattctccccgtcatgtgctatgtatgtttaacaaatatttctaaaacatagggtttgtcccgtccttatcaaaataaatgaattgaagtggaaggacaatagaagctttcctagattggagggtgggtataatgctttgagtttacccaaatcttttagaaaccagaaaatcattgtaagtatttttgataatttaggcttacatggtgttaaattttagctaaaataaggaaaaattaccatataatatttattttgtaaaatgctacttaaaacattaagagatttatcttgggatagacttcttcccacattttctacccttatcctttaactgcttgtcttcaggagaggaaggcatcaagcatagagattaagggtatggctgaggagccaggctgcctgggtttgaaacccagccatgccccttaggagctatgtggaaatcatcatcatggtgtctgcgatttggttctgttgctgtgaggattaaatgaggcactgacaacagtgcctggtacatagttaaagttgtatatgtgttcacaattactagtcagcatcatcaggctgcttttagcagagttgattgaataacatttcttcattttatgttttttttttttttttttttagcatagcctacaagtgcagggactttggaactcgaataacttgcattctcatttgctgttattttacaaattattggccttgggaaagcttttcaaatacattgagcttcagttttctcatttttgaattaatacaccataagattgtggtaagaaatcaatgaaactatatttggagttgctagacccgttcgaaaatctaccaaagctacaaaccatctcccttgaagaaatggaccccttccctgcattttgcatacttcagccatctgtgaagaaacatgtggggatctcctactttataatggcgttgggttaggtgttccttcccatttctacctatgactctacttccctcaatttagagccaagcatctgtcagattttcaacattcaaaaatattttttgtagtatataaaagatttaaaataatattttcttttttattttaaaattatttttatggcgatggggtctcactatgttgccaggctggtctcagactcctggcttcatgcagtcctcccacctggggcctcccaaagaattctaggtgtgagccactgctccaggtcagtttgtggctattttattcaaggtggtttatatgctgtgtaagcggtatctcttaagcctatgttactgaccttaatcttccaggaaataagtaactggagggaattggtccattttacttgcagtctcatggttccaacttgggtgaaattttctgcttccttctcaaacccaaactgattttggcactgataattaggccagtatcagtctatggaaatcagagtcagagttatcattgttaaagactggagtactgactatcagacttgtcatttccttgggaaacaaaaataattaaaatcctgtgcttttttgcccatttaatttagatttataagctccagtggtagcagctgtcttattttagattttgtgcaagaactgtcacatttttggtgctcaattaatgtgtttttactttttatctaaattaatgattctgcccatgaactaatttacatatttccattttcagtactatggaaatgggaaacattctttttaattcaatgcctggaattctagactaaaaattccagatcatcaggcagtagcataaaagacagtttgatttgaaaaatgtgatttcaaatcacagtttgatgtgataaaggattttttttaaagctgttcaacctattttgcttagaaagatggctcagaattgccaaactgattaaagatagaatgttaaatgatttaatcctttgtaacatactttggatactaaaaaatgtaatgtactaaatactaaatttttatttattaaatttataaggtactattccttttctaattattttgaggaaatataaatgtgttagaattgttaagagttttttttttcttgtcaagttgacacggagatttctaatggataggaaatataagtttttaaaaaaagtttccatgtaatcaggattttaggagtatatatgatccatgatataagaattagtagagatatttcattcatttttttcattttggtttttgactcattaagggagctttgattaataggtcctacaaataaatacataaagcacttttgttttcctgtgttgatcatagtcttagtgtatagaaaaaaaaaaacacaacgtataagcacatttactacagaaaaagccatcatcgtcatctgtggaaaatcaatatatatttttcaaaatttagattgatgatcatgtgttagcagtgttagctaaagcttgggggctgctccaggggtcaagtacaggccagcggagctctggcatcatcagtgactatgagattgactttctcaggcagcttacctagcgccggccctgagcgccctggctgaagatgaaagatacacctgagtaagattttgacaggaaatagtaataaataagtgttgtgttggtctgtatctataacactgctacctttggctaagcccagtagattttgcctgtctatgaaaattgaattttgttggtctatttttatggaaattttagaataaagtaaaccattcaaccatagatctttaaaataatgttgcatttgcacttatttatctaacagaattctaagatgttaaatctattcacaccctggtctcttgattctgtaatagaatttttcaaactgaaggtcacaatcaactagtgtgtcctgaatcactttagtggattataaccagcttaaaaacaaaacaaaactagagaatataatagaaaaatccagactgtattgcacagagtttaggcaagtatgaaggtaggtgcatacacacgtttgtgtgtgtgtgtgtgtgtgtgcgtgtgtgtgtactgggccactgtgtaaaatgtattttttactatggttgcactcaagaaagttagatatgataatatcagttactctccccgaaggagactgactaatgacctattcaaattttgaggacacttattcctaaaataggaagtgataatgtgccttctggtgagtattgtaaaattgccactgcattttgtatttggaaatacttatcctcctcctgccctgtttctacttttatgtatgtcttctttactactggtgtattacggaataacgactctcagacagtgttcctatggactgaggtattttactactaaagttgaatggaagagtatttttccaaatcttagaaaataataatgaataaaattatagttcttctctcataagttttccataagtcttcggtgactcttattgtcaggggataaaattaaagtgaaaagagcaaatgggtattagtaggaaaagtcatgcttaattcagcagtgctatctttttcataaacataaaaaattgtatgcttcatgtatataatatggtcttattttctgctattaaaaggtttcttgttcatagggtggaattagagatattgacatttcatgctgttcggtaaggtagtctgatatttgagcaagtctgaaaatgaccctggttgtggaactctaaccaggttcacctcgattttctgatcagcaattgaagttagaatcagtatcacaaatgtggactgagcaccagtagcaacattacagtgacctgagatgtgtatatttaacaattttattacaaatgtgttgaaatacagcctttttcttttaagtctcattatttttgccctcaattttaatttctatctatgtttaggggttactgaaatagcatattctgtttccttctgattcccaaggacacatgatgaatcctttttgagtttcctgaaacagccatctcacctgatgccactgcaaatttctagccaagcaaaggcttttcttcatcttagaattcaagtgacagacagttggcatttttggcatacggagttgggtagccttcctctgggatgatcttttcattattgcatcagtttaactaatagcacacaaacacgcatatgcacaagtactttatttttattgatgaatatttagcttttcttaaatacctgaaatacggtcattataataaaacaaccaaacattaatagatgtatataaaataaaaagtgagtcttcattcttcttggaataatcactctcccccgatgagagttaatagtttgcagtttattgatatctttttttttcatttaccaggatgatatgcgatgttaaaaatgcagacgtagggtgactgaactttttttctacttaagttattctgtagatttattatatataattgttttccttatgaaattgtttattaaggaaacattggaaaatatagataagtaaaaaggaaaacttaattttctgtaatctcatcttttagaaagacttttttttaacgtatcggcatatatgctttcacttttctttctttttttttttttttaaagagacagcatctttctctgtctagagtgcagtagcatgatcatagctcactgcagccttaacctcctgtgctcaagcgatcttcccacctcagcctcccgaatagctgggagtataggtgcacaccattgccccagctaatttttaaatttttcgtagagatggggtctggatttgtttcccaggctgctcttgaacttaagggctcaagtgatcctcctgccttggcctcccaagttgttgggataacaggtgtgagccacagcacctggcctcactttcttttatgtgtgtccatttcttttttctttttttttttttttgagacagagtctagctttgttgcccaggctggaatgctgtggcgtgatcttagctcattgtaacctctgccacctggcttcaagcaattctcctgtctcagcctccctagtagctgagattacaggcatgtgccaccatgcctggctaatttatgtatttttagtagagacaggatttcaccatgttggccaggctggtctcgaactcctgaactcaggtgatccgcccacctcagccttctaaagtggtgggattataggcgtgagccaccacacccgaccagtgcatgtccctttcaatataggcttgatttaatgaaaatgggattttatttatatatttttaaattcatgctattttgacaaggggattatattttcagtgttgttttccatactacttttttcccccattcagcagtgagtgaaaaattatagaaattgacaggctggaactaaaattcatatggaagtgcaaagacttaggatacccagaatttgttttgaaaatgaagaataaggttggaacttttacactctctaatttcaagatttattataaaatcttcaagaatgaaagtattgtggtcttaccataataataaacatatagatcaatggagcagaatatagccctcaaatagacccacgttatacggtcaattgttttttagtcaacaaatgatgttaaaacaactggatattggtatgggaaaaaatgaaccttgtctacttgacctttccctcataaaatacataaaaactaatttgaagtggctcataggcctaaatagaaaagctaaaactatgaaagttttaaaagtaaacttagcacaagataatatcaactttggttaggcaaggatttcttagaacacaaaaaagtactaagtgtaaaagaaaaaatgataaattagattttataaaaaataaagctgtctgctgttctaaagaagctgttaagaaaatgaaaaggtaagccacatattgggagaaaatatttgtaacacaaaagtcttttatctagaatatgtaaagaactcttataacttaaatcaacccgatttttaaaatgttcaaaagacttggacagatgcttcacaaaaaattgaaagtacaggaaaagatattcaacaccataaaccatcagggaaatgcaaattaaaaccacaataagatggagtagctaaactttaagaaaaatgtgagaataccaagtgcaggggagactatgaagcaaattagatctcattctttgctggttgaggtgttctttggaaaacaggttcgcagttttttagaaagtgtcttgtaaagtttaaagtatacataccatattcctaagcattaatcttataggaatgtaagcacatgtccacaaagactttttacatgaatgttcctagtagctttattgataatattctcaaactggataaaacctcaaatgtccatgggtagagtaaatggttgaatacagtgtattattcatacaatgggatactatttagcaataaaaaagaacaaactagtgataaactaacaccatatggatgagtctcaaaaatattatgctaaataaagaagccagacatatattgtatatttcctttcatatgaatcttaagaacagggacaaagtaagctgtagtggtagaaatcaggcaaatggttgcttgggatgtggtggggaattaactgtaaagggtgatgagggcactttttggaatggtagaaatgttcatcatattgtggtaatagtatgcatttgttacctgtgtgttaaaacataccagacttacacatttatacacatcagtatatttcatgaaaaataagttttggtatagctatgctttatttaaatgatggaagggtgcctttgagaagtgtatgaattctgctgttcccctacttcctagccacacaatatgacctaggctgaatcataaaataatttaaaatgagcatttgtggcaattctctgaaaagagtaggattttgggttggtggggttggtttgtacttgttaattgcttctttggaagctggctatgcgtgctcagtttgcataacccccaactaatctcagcacttctgaacatgttaaagcattaaattctaatttctgtactaagagttatattccttttccctcttctccagtaactaagagagctttagtagtgatttttgtatgagtggatgacctttgagcttttttagaattttagaacagaatctggtttccagaaataatgttttaaaacctgcttggaatttttggtttttgtctgtagggtttcaaaataaatgtattttatgtctgggctttttgtgttttattctgggtttctttcttcattaactcggtatccagctcactaacttttccacttttccttgcccaaatccatgtatggttaatatgatttttagcctaataacattttttccctaatactttagaggtaaaaaaattataaagatacacagtgtagatttgtgaatatttgttagtttttaaactaatgagttttacttattagacatcagatgaacgtactttgttatattatctaataatgcacttttaaaaacttacagtttttaaaatagctctcttaagagatccctgtgatgcaggctagaagtgataagaaattttcttagagttttgaggaaactgttgctgtaagtgtattttaaaagctgcagtagtgttcttatgtcctcttgggactgaactgtttgcccacgtgtagtacatttgtgtttatgtggttaaacaacaacaacaacaacagaactgtagattcatgttcataagatcaaagttttcattgctagccaatagtaaaatatcctgtatcagaatattaggaatatctataaatcacttaaaactttttagtatctttgtaagtgaaattgcttgtcctttttttccataaaatcaggctatatatatgttaaataagaaatcttaaaaatttgatgtctctgtgttaagtataagaattctagattattctgtgctattcttacctttattttattttattttgtatttttttattgtggtagaaaaagacatttcagaatttactatcttaaccattttcaggtgtacgtttacattgttgtggttacctttatttttatttatttatttatttatttgagactgagtctcactctgtcacccaggctggagtgcagtggtgcaatctcagctcactgcaagctccacctcctgggtttatgccattctcctgcctcagcctcccgagtagctgggactataggcgcctgccaccacgcccggctgatttttttgtatttttagtagagacgggggtttcactgtgttagccaggatggtcttgatctcctgacctcgtgatccgcccgactcggcctcccaaagtgctgggattacaggcgtgagccaccgtgcccggccggttacctttattttttaaggtggcttaatttaaacacacgtatcattattgcccagcacaacaaaggatatgtgggtttacttagagttttctttaatttaatatcactagtctagaattctaagaagttgattcacacaccatttattcctggtaaatattctctaattgtttgactagtaacctgcatattctttctatcattcttctaattgtggcctctattccttaggatattcccttccttctcttttttttccttttctcacctgttcacaaaagtattttttttttgaaataaggaataaataacgtacgtggaggaaacagatgtgttcatcttaaattcattatttttcttacataggtttagatttttttttccagaagagttgatcttatggcatatgaagtattcttagaacatatccaggtgaagcagtcatggctgagacacagtcatagttaaatgatggcattaggaagaacgtggaataaataaataagacccagtgtgctgattttcctactgcctgagtccttttagctgccacaaacccatgatggaaaggaaataaatatgtcaagaaaaagtaagtttttttgacataggatttgtatttatggaagtacagtaaaagtttttatttcatgattgttactatttaaaatatacttttctcatataggtgggaaataatttctagagagctccatgaaaggaagcctgacattttttggacataatattcttcatttgtgtgttttctcttaattgctctcgccttttctttgcgtgtttttaaatatttagtttaaaggctgggcacggtggttcacagctgtaatcccagctctttgggtgactgaggcaggtggattgcttgagcccaggagtttgagaccagctgggcaagatggcgagaccttgcccatacaaaaaaataaaaaagtagccctttgtggtggcacacccctgtggtctcagctcctctggaggctaaggttggaggattgcatgagcctagaaggttaaggctgcaccactgcactccagcctgggcgacagaatgaaaccctgtctcaaaaaataaaatactcagtttataatcctgaaaaaaaaaaaagattaatgaggcactattctgcctttagtactttgtagcttcttgtcttactccttaggcaagcacagaaggtataatgtgcctgggacagaaaaatctactatgtgcccagagcttgactcaggttgtcttgtgaaaacctgacagtattactaggaagtaggtaatagcatcccctgtcagccccccaaaacacatacattgactgtttggattgcttggtgatatctcaaattaatcattggcagaagtaggatctaaatcgaaggatgatgataaagattgtgtgccttctgctctatctttaaagctgcctcatgctgccagggagcaagacacagtgaaactcattgtggataattgggtccatgcctcactaatcagaaaactgagttgcaatatattacatttctctgttctattatgatgggagtaatttcattataagtgagtttttatagcaccatctaaaaagaatatacactttaagaaaatctaaaatccaaacttagaaagccagattaatcagggatatttattcactttacattggtgtctctcaattttataaaagaaccaattgtactacagccttccttaaatggacatcttccaaatgtttcgtatgtttaaactatttgagttaccaaaattgaatttgtgtggaattttttagactacgtcagtgtgtaaaatgaactgagtttcaagtgaagtctattcattttgataatggatagaaaatcacatagcatttaaaatgttgctcaagtttattattttaggcatactgttaactctaaagaaatgggtaaatgtataatgaagtagttaatgggacagaaatggaattatcccttttttttccttttttttgagactttactgttatttttggaaaacatttaataactcttaatattttagtagccattatatcagagatgctacttttgtttttgtagaatagatttacagagtacataagcagccagactttcccacagggagtgacagaataagttgtgcagttttgggaggggttacattgaccaataaatgatttctgtcagtacccaaagggcacccttacggcccaacagaattaatgaaactgtgcagcagcattaatttccttttgaaaggcttaggaccaataatactgtccttattttctaaattaaagtgaatttttatataaatacagtttgttatgtgacacttaagaaatacagtgaaaggttttaataaacagtctaaactatacttaagctgttttataagaaaaataaagtgaagagttggtgaatttcattgatatagataacgagttactttggtctcagtagcagattttgacttgaaaaactaaataatggctgtatttctctgcctcatttaattgtgcaccattttgcttttttggtcttttatctataatccatccattactcccctttgagattaagttttctaaaactctgctttcattcctccctcaacttttccatgtcttataaattgcctcttggttaaagtcccagcctagtgtattttacagccccatctccaagtatttccctatgcggccttgcacttcagccagatgtctctagccagcacttgtgacactctctttgtctttctttctgtccacgtcctatatatgctttacagcatagaagaataagccacatttaactttccagaccaagccagcacacttgtatgtcaggttttgaaattgttgcagctttgagtataaaagctgttatactttgcattgtcttctaagatttctaaactcttaagttatttctctcatttcctagtcttcatttggaaatttactgagagcagaggcctgcatcttatacttctgagtctatgttgaattcattcctacagtgtctacttctatgtaacagtattttacacatattgaaaccctaaaaaagacacagaattaagtcatagaattttagggctagaaataatttgtaaaaggttgtcatttatagttgagaatactgagtcatagaaatgttgattttgattaatagtatcttgaaatcatggtatggcttggagaagtgttatctgttatttttattttagtagggtctttgtggtggttttcactttgattctttctgaagaaatagctttaaaaatccttagcacttggatatgtaattattttactaagataattttcaaacactttgaatagttctacttaatacacggaaactgatgatcaaacatttaaattgaaactgtttggacctgtgaactggtttttactaaaagctggagtactgtgattattggtccctctgtgcagtaactccaaaatctatgttatactctcagcagtcctatttatatatgttattggtgtaactattactctgttggtagtcttttcactgtatctggaaatgcagtccacctcctgaggaaaaaaggaaaaaaatagtagtacttaatactattattcccacagagcttcagaaattggcacaaaagttttcatgttaatctcacaaatgctgttattttgaatttatttaatttcaaaacagtattcagtgtcttttcatgaaatgcaaacttaaacaaggtcagcattatagaaggaaatgagaacagtcttaggagtttgtattaaaggagatagctatggttgaaaggaaaatctgggctactagtaacttgtgtttatttctaaaacaataatttttcctcccccaaggcctggtagggtgttttgaaggttgtatgtaaagtcagacatgatcgggttgctattattgtcctttaggagaactgtagaagatttctgctgtgcagtgtcaggaacaggttgctgtggatgatgagagtatcctcattggccactattattctgtatgaatcttctgcttttatgaacctttagcacatctaggggtaaaaggcgtgttttatttcagagctacgaggtcagagtttggatgatatgctgccaaagtgtgtgaattgtggctactggagttctgagatcccatctttgcctaaaatcagaattctagaacagtaagcattcaataagcactccaagcttccaagtaaccttttttttttttttttaaagccaatggctgcttaattttatacaatggttttcttgcttgttttctgaatgttgtagataaataacttatgccggcaatggatatataattctcaatcagattcttagggaaaaagccaaagtagtaaagaaaaccttttatatcaaaaaatataatttgtaaatttgaggtttagatttaaaaaataacattaatatatacatattaaatatatatatatatgaactcttctccccccgaaagcccctgagtattaaatattttggtcttaccaagtcgtgactaaggcatattaaagccagttcacatggaaacatttaataacctttatattactatttcctagatttataatttgtattagatactgtacagagcctgctagagaagctttgtgaacctgtgctctgtgtatttcccccctcttttaacagttgagaacatactttcatcagtctgtgtccttttctcaaatccacatacttcacttttgggatgctatttttccccctagaatgtggtcacaagagccttgtggtcataggagggctctcgtgggatctttggaattggcctagattcaggcttgggtgcccgaaattggtcttgtggcttttgaggccaggcagtgaatgaacagtgtttaatgctggtaagagaagcacatgctcatggctttgttagcttttgtttaaagctcttttccctgagttgcatgaggtgcagatttaataattatgttcatctcttgcttatttcattattttccctcactgtctcttccttctgtcattaaaatgaaggtgtttgttgggctggtgattgttaagggcctggctctcttgcacctgtggttttgctgggtgataatcttctttctccgttttaaaatttatcctcttctttcattgtcatatttactcatttctttctcttttttctcccttttcattgtgaaggagaacttagagcagtgttttctgttcttctgccaccggcaatggcttttataggcagaaagaacattggtgtctctagtgtggaacacttataaggcattttaaaaacatttacgtctgtaattggaaaagggcaccataggaaaatatgagctttaatcattaactttctagaagtttataagatgggagtattttctcctgaaagaatacctatggtctatttgaagcttaggctgaaaaagagtaggatgctgtataatttggttcagaattagatgatttagagactacatagataatcagagaaggaagaaaaatttggctatatgtagattccttgtttttaactagaataggacttctttctctgggcatattatttatggttgtcatacctgttttttttgtttgtttgtttggattttttttgtttgtttgttttttgagacggagtctcgctctgtcgcctaggctggagtgcagtggtgcgatcgtggctcactgcagcctcgacctcgcaggctcaatctgttttcccacctcagcctccctcgtagctgagactacaggtgtgctaccatgcccaactaatttttgtatttttttgtagagatggggtttcgtcattttgcccaggctggtctcaaacacctgaattcaagtgatgcaccctccttggcctcccaaaatattgggattacacacatgagctactgagcccagacacatatgttctaaagagttggcacttcataagaattcattggattgaagtgaatatattttttccaaatttcttaaccacatcactcggccattgtaataagaccctcctagacttgcagaaacacttggaaccacatcagagtagatgaacagaaatggtaatctctaccacagaatctctatgctgatgtgcacagactgggggaaaaaaaaaaaaaaacaaacctttttactttatagaactggtctggtagttattgaatatattactttgctcctgaaatttgctagtttttttttttttttttaagtattgggagatggaataatgtagtggtcaagagagactgtgtcagatgcatttggttttgagtcttatctcttccatttatgccctgtgaccataatcatctgtgggattagcatgctagcttaagaattctcatgttcatctttcatagctcagagtacactaaactaatagcagttattagcatttttacacttcaccattaatagacttcattacgcatcatctgatttagttctgcaaggttcctcgacgctgtttcttgctgttttcagtttgccacattttgtcttcaaaaacattgcatttttctgaaaaagtcagagctggtgttaccatcaaattaaacagttgactaaacatttttcccaagtaatttttttaatgctttttgcatacaccttttcttccttttctccactttccacatactgtatttgaagaatgagttttgtggctttgctttcagatatgacatttccttttttttttcagtcctaaatgtaaaactcaaaagttttaagccatagcccctttatttggtgttgggattaacagctaaggtaatgcttcctctccatattcttcctggttgtagagacgttagtcacatctgctttcagttcttgtctttctaactggagactgtgtcccataacgcagcagtctttctcttcagcattttttttttccattctttgagtctttatttgtgggttttttttttcattgttgtatcccacctgtactgcatatagcattcaagttgtgggaatagcagttttataatagcataaagaggggttttgtttcccatacactcctgaggatggccggcatcttcttgaccttgaattgagggctttaaaaaaaaatcagtttatatacagtaagatccatctctttaaatgtgtaattctgcaagttttggctgatgtatgtagacaagtgtatgtagtcagaaattttactctgcttctttttggtcagtgccaaccctaccctcagttcctggcaaccactgatctgtttttctctttctgtagttttgccttttctaaaatgtcatgaaataacaatcctacagtcttttgagtctggctgttgggtgtatgagtagtttattcctttttattgctgatagtatttcatagtatggttgtatcagagttttatctattcacatataaaagacatttgggttgtttccagtttctagcaattatgaataaagttgctataaacttttgcctacaaatttaggaacataaatttttatttcacataggtaaatatctaggagtgggcttactaggttgtgtggtaagtttaaacttgtttacttttttttttttttgagatggtgtctagctctgtcacccaggctggaatgcagtggcgtgatctctgcttactgcaagctctgcctcctgggttcacaccattcttttgcctcagcctcccgagtagctgggactacaggcgcccgccaccacgtccggctaattttatgtatttttagtagagacggggtttcactgtgttagccaggatggtctcgatctcctgacctcgtgatccacccaccttggcgtcccaaagtgctgggattacaggtgtgagccaccgtgccaggccttttttttttttttttttttttaaagacagagtcttaactctgtcaaccagctggaatgcagtggcaggatcacagctcactgtagcctcgacctctccgggctcaggtgatcctcccacctcagcctctcaagtagctgggactataagcatgcatcactacacctgactaatttttgtgttttttgtagagacggggttttgccatgttgcccaggctggtctcaaactcctgggcttaaacagtcctcccaccttggcctcccaaggtgctgggatttcaggtgtgagccactgtattcagcaagcttatttacttgtaaacttaacttgttaaacataaactttataagaaactgccaaatagttttcaaagtagctatgccattgtgcattcccaccagcagtatataaggttttcagttgctctgaacctcaccagcacttggtattgccaggttttttcttcttttaaccattcggataggtgtatagtgggatatgtaattgagttttcattttcttggatgacaaatgatattcagcatgcttttgtgagcttatctgccatctgtatatctttttttggtgaagagtctgctaaaatcttttgcacgttaaaaaaacctttttttaattgagttttgagaattccttatatttgctgatcagaagtcttttatcagatatgcgacttgtgagttattttctcccagtttttggcttgtcttttcatttatcaattattctttgatggattgttttgagcattgattttatactatatgaaaaaaggttttaaaaagtccatctaaatatgtctatgtgcattaacgtagacgtatggttttgattatccttttttcttgttttccctctattgtttgacttggcctttctatattctcccctttgctcacataaacacatattttccttatttattttaaaattaggtcctttagggcaatacagtaaatatctgtgctccaaaaaaatcaatcctgtcacaccaatgtttaacggactttgaaagaatgcagctgtatggaggaaatgaattctgttctctgtcaaaattgtaaaggactgcttgttttaacagctactgaagatggaagcatttatactgcggccatacggcttgtcaaaactagatatgttcctgtgtttaaaatatttgggattttccaaaagttaccattttctcttgatccttcttaaggagtactaggtttctgattacagttaactcctacttcactgttaaactgtctctgaatagacttaaaatatttagcccatttagataaatgattgagcgtcgtaagtattggcattccattttggacatttagaaatgtatttacatataattggattatttcagatttctctattaatggaacaggttggttctacgttctgtaaaagtagatttttagggaaagctgaagacaacatattcttttgaataatggtaggagataatatatgtcaaaatgtcctcatttttatgcatattaaagagttagaatatgtaaacatctaaaatgaattaagatttcatacatgttatttttttctattcaatcatgtttttcttctttctttctttttttttcttttttgagacggagttttgttcttgttgctcagactggagtgcagtgagcctcctgggttcaagtgattctcctgcctagcctactgggtagctgggattacaggcacccacaatcacgcctggctaatttttttgtatttttaatagagacagggtttcaccatgttggtcaggctgttgatctgctcaccttggccacccaaagtgctgggattacaggcatgagtcactgcgctgggccctcaatcattttcataaagctagaattttcattgtaaatgtttgctctgtagagacagttttgttttgaagaagctagtattataaaatgataacagattaagatcagggtcattttatttaacaatgcaaagttattagcaatggtggatttaggcatagaattttatcttaattttttaatttaatttggccttttagaaaaacagcttttgccattaagcagtgtgtttggccagaggccacaatgagatcagtattttacaagtaacttttttttttttttttttttgagctggaatctccactcactctgtcacccaggctggagtgcagtggtgtgatcttggctcactgtaatctccttctcccaggttcaagcaattcttctgcctcagcctccctggtagctggaattacaggcatgggctaccacgcctggctcatttttgtatttttagtagagatgtggtttcaccatgttggccaggctggtctctaactgctgacctcaggtgatctgcccacctcagcctcccaaagtgctgggattacaatcatgagccaccgcacccggcctacaaataacattttaaatgacagattatattgcagtcttctgtttatgtggaaatgaatggttttgtgaaaactctggcttttaaacaggtgtattgcaagaaactctcttggtgggatgaaataaccatgaacataaaatcttccaatgacctcttttaaaatctcctgtgctgtaattaactaccctttaaatataagggttctgtttgtactgctaattaaattcatagttaagacttgtagaatagcatttaatttatgtgttgttttgtcttgggacttcactaacttgaaaggtgatgaaggtataaatagtgaattttcattaaaatgtaccagaaaaatatgtgctaaattctcagataatgactagcttgtctgaaaactaaacatatggctaaaagggacaaatcaacggttttcttgctgtatgctacagttttatgttaggctctttcatttgctcattgatcctgatttgattttggaggcatttaaaatgtactaaaatttacctgattacttataaattagcttaattagtgtgggcttctataaataaaaaatactgcatttgttatagttaattcagagtagggataacctcaaaatatttgtgtcaaagtttttgtatctgtttctctttcctaagggattgcagcaaaacttagagcctaggaagagaaagagaaatatcaaagatggaactgggagagatagacactgcagaattaagcaagatgaaatgatccacattcaaagtaaaattttagggcagggtatgtatatttgaaatgcaaataaaatgtagagtgattacctcagtgtttattagaagaatttgtccttttgcaggccagcacaggagggtataaatctctgttaaggagtctaagacaaagaagatattaaaaaaattgaggtgaagttgagttaataatatagacttaacctttttaaagcaaacaattcattggaatttggtacatgcataatattttgtaaccaccacctctctctagttcctaaacattttattatggcaaatggaaactcagtatccattaaacagtttttccttgtaacttccccttcaagagtggctggcaaccactaatctgcatgttgtctctatgaatttacctattctggatatttcatataaatagtatcatattctattgtaccttgtttctttttcttagcacaaattttctaggtgcatttatgttgtagcatatatcaattctttattcctttctatgtctgaataatattccattgtatggatataccacagtttacttacctgttcattcattgatcgacattttggctgttgctaccttttggctattttgaatagctgtcaatatgtgtacatgtatttgtttgactatctgtctacactttcaggtatatacccaggagtggaattgctgggttatatggtaattctgtgtttaacttcttgaggaaatgccacactgttttccacagcagctgcaccattttatattcagcaatgtatgaggtttctaatttcgctacatcctcaccaacacttgttattagcaatttttttcaaaaattgtaatatagccatcctagggagtgtaaagtggttatctcattgcagtttttatttaaatttccctagtgaccaatgatgttgacatctttcatgtgcttattggccatttgtatatcctctggagaaatgtctgttcaggtcctttgctcattttttaatcggtttctctttatgttgctgagttgcagtagttctttattttagatactagacccttatcaactatgatatacatatagttttcaccaatgctgtatgttgtcttttagttttcttcataatgtccctagatgcacacacactttaaattttgataaagtttgatttatccatttttctttgcttttgcttttagtgccaagtcaaggttgtaaagatttggcctgctgtgttttcttctgagaattttatggttttagtttttacattttggtggttgatctattttgaattaattttttatatatagaatgaggtgggggttcaatttcatttttttgtatgtggatatgctgttgttccagcatcacatgttgaatagaccattcttgccccactgaatactcttgacatcattgttgaaaattagtttgccatagataatgtatttctggactctgcattaaattccgctgatttttatatgggtctttatgctggtaccacactgttttgattatgatagctttgtagtagattttgaaagcaagaaatatgagttcttcaactttgttcttctttttcaatattgttttgactattcagggcctcttatattttcatatgaatttgaggattggttggctctcatttctattaaaaaggccattggaattttgataggaattgcatttaatctttagatcactttgggtattattaccattttaacagtattaagtctcctaatgcatgaacagaggataatttcccatttatttaagtctttaattcctttaggagtgttttgtagggttttttttgttgttgttctgttttgttttttttgcgactgagtctcgctttgtcacccaggctggagtgcaatggcatgatctcggctcactgcatcctccgcctcccaggttcaagtgattctcctgcctcagcctcccaagtagctgggatcactggtggacaccaccaagcccagctaatttttgtatttttagtagagatgggatttcaccatgttgcccaggctggtattgaactcctgacttcgggtgatccactcgccttggcctcccaaagtgctcacattacaggtgtgagccactgtgctcggcatcttccccccaccgcgctttttttttgagatggagtcttgctctgtcgcccaggctacagtgcagtggcgcacgatctaggttcactgcaagctccgcctcccaggttcacgccattctcctgcctcagcctcactagtagctgggactacaggtgcccaccacaacgcctggcgaattttttgtatttttagtagagatggggtttcaccgtgttagccaggatggtctcgatctcctgacctcgtgatctgccgacctcggcctcccaaagtgctgggattacaggcgtgagccaccgcacctggcctttttccctttttaaggctagtcaagtaaagcagtgagagtggagaagaaacaaataaatctgtaaatggttgtgatcagttagttgtaaacaccactgcactctggccagccgtgttttgtagttttcagtgtaaaaaaaaaaaaaatttttttttgcctcttcagctaggtatattattcttttggatgctatggtaaatggaattttcttaattttttttggattgttcattgctggcatatagagacacaactggtttttgtgtgttgattttgcaccctggtagaggagggcatttcaaataaattttgaagattagaatttgatagctaaaataatgtgggaggagtatgtttgaagcaggcggaactcattaagcaagcatttgttaaactgccaccttcatgtataggtagtggaggaaacaaagatttataaaatgtagaagctaccctcaaagaactatgttagggaaaataaccatatataataactctaacaggaaacagactatgagacatgaaatgcagggagaaggccaagaaaagatgactttaatctagattaatgatgttccctgttatgtaaaaacaagtagtctttttagtcatgccatcaaatattttggtagctaaatgacagaatgaatgtgaaaataccttttgaggtaaaagcattatggtagtatacatactgtcaaagcattatggcagtattgtaaggtgaagttatttctcctctgctgtggtttttacgtcatcagtctgggtagcagtcaactaataggaaaagcgttctgcttttagggatgttcagtagttttaaagggttaatcaggaatttgtgatctgcttgttttttaggaaaaaggatatttatttataactattaaacacaccgttagaattaaaatatgtagtatttgaaactttctagcctttattctccacttgtcctttttaaaaatcattggttcagtagtttctgtaacaatttgtcataattcatggttccttaggaatacagctattagagctatgtgcctatgctgctgtagaatgactagtggagtgattttacttgtttttgctgcagggatacttattgggaagaaaaaaagcaatcaactctttctctttttctttttctttttggtatcatttacagacattgggtcttactatgttgcccaggctggtcttgaactcctggactcaggccatatgcctacctcagcttcccagtgttgggattataggcatgaaccactgagcctggctgtgatcaactttttataagggagacatggattataaaattatctccccatagtccttctaaattctaagatggcaggtaaaaattattattataatcatatgtttagtctgagaagtatgaaaatacttgtgtagcccttgggtagacagtagttccatttaaatgtagtatccctctacttctactggagataaccatttagtcccattcagaatcatgagagagattagcataaaactttatattattagattaagttttatgtaatatataagtagaagtatgagaaaatgatttcctagaatgaggatggcaaatttaagttcccattctgtctttagctgttcagcatgtccataacagatatactaatgaattacaacttttgttttgaaatttgcacatggccttaaaagctttcttagcctagggcttcaggcagtattttggagtgtgtaggtaacaggaaactatttgcatttcttagagcaggggtgtccaatcttttggcttcccccacattgaaagaagaattgtcttgggccacacataaactatgctaacacgatagccgatgagagaaaaaaaaaaagaaaaaaacaaaaaaatctcatgacatttgaaaaaagtttatgagtttgtgttgggctacattcagagccatcctgggccatggattggacaagcttgtctaagagaatacaggttccctgaggatagttctcaccccctcattttattgatcacactgtatcttcagtgcctagaatagtgtctggcacatgtaggctcaatatcaaagtaaagagtggaaatctgtcttagaaggtgtttgcgagatattctggcttgaaggactcgtaactgtgcttcctttgtttcagagtcagaatctgttccccttcaggtggatgtttgtgtgtttttattaacttaggtcagcactgtcttctggttttgaatgttcttctgtgttcttcatactgagcatggctgatctggccatgtgccacacatatggtcaacatagtaatagagatagaagtacaattgataacttgatcagcattcatttcgccatatataatagcttggtttggttgaatttgcgtttaaaatattatacagagtgtgctaattactgcagtgtcaaaatggattagacagctgacaaagcaaacattcgaggaccaacatctgtgccaaaacacctttaattactgtaggctttgatcatcttaatttttcccataaataaattcattatattggtactgttcacatctcagagaataataaactatcagctttttcacagtttatgccatataagaataaatgtcttttcccagtcttgcttaagtgaagttctgccattttttcaagattgttattatgcaaacatatttttcatagaattccttagcattaagtagagcttaagtatcattaatattaaactcttaatattagttcatctaagagatacgagtattttcctagtagataccattgtcaagagacttggagattagaaacatattgttaaatttcttcagagatgaagggccaggtttctctagtccctggcccattgggttaggcctatgtttcaaatttttgtatgagtttcagactgtagaatagttattctgtgttaagaaagcacattttcaaagcatatgttttctagagaatgtttgctactgccttaaagtagaagagtgcatactcctgaaatctaccttagaactatcttcgggggaatcatgtgagaaggtgcagacttttcattgatttgtagttgagtatgaatttttcctctgagataacttaagccacatcaacaaaacatcaaaataaatcgttataaagttcagtcagatttatgatttggtatttcaaaagatcacatggttacatagtggtgatttttaaaaataactgtttaaatcacttttataaaaacagttcaaacaatgccctaacgatataagaaaagataagaatgacatacattttcatattattggtgatgctctgtaatgggtttggaattacaactgaaaccttcttggtcatacccttgggagaaggtagattgtgcaaataaagagagtagttcctttttttaaaggagaaatggtttcatttgatagttacaactctgatggattccagagctaaggttttggcattcattgcatgcaattagggagattaaaaatggaactgattttcaagtagttttattgggtaaattatattaccatatttaaccatttataagggtcagtgtatttataagacatatctaaaggtcttaatggggagttaaaatgtatatccagcaaacaattctaggacactgcgcaagcttacataatcaagcgtacttaaatcgtataggccaaaccataattaccttagaacttagatatgggagattatcagggttggccattgttattggtattgatatttggaaggtatggacaatgtgtcacatagtggaaagagactgaactgctgacagataagtaacaaggttctagtccaagttttaccattaaagatgtgtatgactttggccaaatcacttaactttctaaacctttagtttttttcatttttgaaatgagtttatatgatcattttgatttctaaggtctcttctgtctttccatctagtatgctaaaaaagatttaccagataaaaacttttttttggagaaaaagttggcttataaacataatgtttggccaggcatggtggcacccccctttaatcccaacactttgggaggctgaggtgggaagatcatttgagcctgggaagttgagccttcattgagctgtgattgtgccactgcacttcagcctgggtgacagagggaggccttgtctcaaaaaaacaaaaacaaacacatgtttacggatggtttaggtttcttcaaatatcttaaggtggttggttttcctaaagaggtttctttaatggtgatagactgtcactgtgctatgactttaagctagattgcagtagttacttttttaaaaagaaatgtttttaaagtaaaacttgagtttgcattaatagtttggctctaacaacctaatattttcaaattaggaaaaatttgaagctctcacaagtaattcagcattaaatatgagaatgtactaaagcatagggtggattgaggcactgtatgttatgctactactaaggtagtagcaaaataagctcttatgggtgttatctgctgccaggatggccagattgaatcagaaacaaagtcaagatttcagctggtcaacctgttttatttaggacaatgtttggcaaattggagagtgtgacctgtaagtgggttgtaaaattaatttagtggatcacgaccagtgttaagaaaactgtaatagaagagaatagaaaagatgacagtatgttacatgcagtaacggtaattacttgtttgttgcagttgttgtatgtattggttcatggtgtgaaatgtatttcttaactacatggtgtttactatgagcacttagcacagctcatagaacattcaagataataggcagtcaatgaatgttcaactgcactaaatttaatttaaacttatataggaaaaaattgcacaagtaatttcagaaaagttttctaacacaaaatggcattaggaaaattggtagaactttaactgttgtgctggaattatcttgttatatgcctgtgaccttcttgggtctgtggggacttagctttatatcagtgtgcatgatggaagagcctgatttttagagtcagaaagaactgcgttccaattttgtctcttgacccatataaacttctggacattgggcaatttttttcagcactctgagcttcaaattcctcatttaaaaaagacgacataatagcacttacctaacgattaagagagggatcaattctaaacatctaatactttgcctggaacatagtagatgcttaataaacagttaattaaaagggtatgaaacataattgaatactagtatatattttaaaacactgttttgagtatccaggaaaaagtatgaagtgtaagagtaattaaatcacatgcatgggtagaaattccttgtgaccttttgaaaaattgaaaaaaagcataattgtaaaagattgcttccttttttaaaaaaaaaattgcccagttagcataatatgcaagatgtaaactagaaattaaatgagccaaaaccagagttagttgcttgtaaagattaaaagtgaactcacactgggtgtggtggctcacacctgtagtcctagcactttgggaggatgaggcttgagccaggagtttgagaacagcctggacaaaatagtgagactttatctctacttaaaaaaaaaaaaaaaaaaaaaattagccggggtggtggtgtgtgcctatagtcctagctactctggaggctgaggtagggggattgctggagcctaggagtttgagcttgcagtgagctacgatcttgcttgtacttcagcctgggtgacagagcaagactttaaaaaaaaaaaaaaaaggaaaaaaagaaaaggtgaacccaaataaatgctctcaagtcaagaaacctagataaagattcattagtaattattgaaattggttgatattcatgtgtaaattatatactcagggatgaaaaaatagggatatgtttagatggaatctttatagaaattttcttttagaattagaagcagacaaaactttaaagaatagaatatcctgggtttaattagcaaacaagtacaatcagttgataaaatggtgttcactcaagagttttcagagaattaataggtagagttatggagctgttggctaaaatgtataacctattactcttcatatcaatcatgttcatataaaggtaggttgtcggtatatgtttaccgtggtttcaatgccctctctaaaactcaggttgaaatttaattgccattgtgacagtattaagagggatcatgaagaggtgattaagccgtgagggctctgctctcatgactggattaatgtcattattgtgggagtgggtttgttattgcaacaatgggtacttacaaaagtgagtttagctgtctcttgctctctcatgctctcttgtccttccacctgctgccatggcacagaggccatcatcagttgccaagcatcttgatattggacttccctgcttccagaactgtgaaaaacaaattgctttataaattactgagtctgtggtattttgttatagcaacacaaaatggactaagacgatgtcccattataagaacgtttgtagaggacttacagataactatgggtcagcttgtcttgctatatttttaacactcaggagtttagaataaaacaaattattgaatttggttttgtaaaccaaaaacctgaatgattggtatactggagttatttaggggattatggagtatgttgaagagaaacagtgaaaataatttatgtaaactttacaaaatctttcaaggttctaatctgaaaggaataaaatcttttgtgttaccataggatggaggagaaatgtttattcatggaatcacattgatttagtaagtaaacatcagttgtgaactgtcactctttagaggaaaaagtgtattatgtgggtccccaagttggggccaatttaatttcacattttaataaatggtgtaaaagaaggtgtatgtagtcaatttttagctcttttggatagtgaaatatcccaggaaaaaaacctaactgcagataatgagtgagcaaaaaactgagtgaactcatgtgagatagttttcagtggtatatttgggggaaaaaatcacatgaattataattattaactgaggagtcttgaatttagttaaagtcaggaaaagaatctataagctatcatagatgattatggatactgtgctaagaagatccacagtatgctagacattttttgagagtatgggaatagtaagttatcttgccattattcaaaatcataccttatacacacccaagataaatactatatgttctgttaaataaaaataatgaagtgtctggctacgtaacagtatactaataaatatttattccttggggcttttaatactaaggaggaagtggaggaggaagatgtaattgaggttctaaaatgggaccttggatgaattactcaaattccatcatgctggaattgtgggcagagtatgggtgcttctaggaattttataaaagtcagtttaagataaatatcttaattatctatataatattagagagtaagttagtggaaattagtaccataagatgggatatagactgaacaaattttttatgaaaattagattcacagatgatacatacataatagaatagtaaagaaaatctgagatatttagaacatattttttcctatttgaaaaaatgacatgaagatcttcatttagtgtcagacagaatctaggatttatggaaagcttaggagttaaaactagtgaagtatagttggttgtgactggagaccactcaaaatgtatagtggggttatcaatactttttatcaggtgaaggaagaagcttccttctatacggagtttgctaatagtttttttcttctctagtttgcatctattgacatgattatacagttttgctttttttatttgttaggggatctcaggtaaaaattcatagatttttaaatttaacttgagataattttggtaacatacatttctttagaatattacccatatgtaaatttgataatgtctgtttctctagaatattacccatatataaattttcaaatattggcataaagttgttcataatttttttttattgtgacagctctgtatctatgggtgtaatgatgtcatttttcatgtgtgtatgtttttgtttgtttttgcttgattttcttgacgtcacattttaatagtagggactatactgttactcgtcattttacctcaaatataatactcacaggtaacaggctccagtgaacttccagtgaactgaataaccttgactttaattcttctgtttctggccagtcttctctgtgtccattgctaactttccttccccttttccctcccatcccccactgccatgccccccacattttcaattttttccctctcttctatgccagtatgcccttttaatttagtgatcttatgcaatccaagcttttgccttctcttatttacatagctcccaaatttataaccttaacctgacctttcttctaagctttaactgctggcttgacatttctccctgggtatctccttgcttccaccttcagtgcagcacaaccaaagtgaaactccttacttccctccacccaaaccagttctttgtccaaatttcctggtttctattaattggcactgccactcacccaggctcaaaatgtcagtcattctgagactcttctctcttatcttacatgtgctcatctgcaaagctgtacattctactgctacaacctccctatatgtatacatgacctcccttatcatcccttcagccaccacctttattcagaccctcactgctttgtacctggactactgtaacacctccctgtctgattgaatctagttcatctgttacactgaggtgagattaaatttgctaaacacagtaattttgtaccactctttagccccaaattacgtagttctcatagctgctaaaataagaacaaactctttagcttttccaggtcttccataataatgcccaaatatacccatcttggcttgtctttcccttactaccttactggcacctgtattctagcataagtgttttatctctattgtactttttaaagtttctgctcagctgtttgctcttcagggaatgccatttcccttatctctgcctgttgaaaggaagcttgtcgagggtaatctcttagattctttgctaggctttatgacccacaaaacacttttctttatgctttttagggcacctacctcactttgtattgtagccaattgtttacttgcttaatatttcagattataagcccctggggggtaggaactattttttactcagctctttcctttttattgctttagcaaattagcatggacaagaaatattgattgaaaataattaaaatgattacagttgttttttatttccttcagtgaaatttcctacactctcttcttaagaagtttactccaatgcaaattaacaatacagaagtccagtaaatttatctattttagagatgtagctgcatgtgtacaagtcttgttcttggagtgttttgtgttacttttctaacaggtgctatcttacagtataataaggtttctgcttgaagtgagaccagagacattatagttgaggcattgattgattgtgctgtagcggggctaggttatatctacctctacacttgttctggatatctaaaaatttttttaagacaaggtctcgctttgtcacccagctggagtgcaatggtgcaatcatggctcattgattgcagccttgacctcccaggctcaagtgatcctcttacctcagcctcccaagtagctgggaccgcagacatatgtcaccatgcccagctcattttttttttctttttttttttaagatggagtcttgctctgtcgtccaggctagagtgcaatggcacgatcttggctcactgcaacctccgccccctgggttcaagtgagtctcctgcctcagtttctcgagtagctggaattataggcacccgccaccaagcctggctaatttttgtatttttagtagagacagggtttcaccacgttggcccggctggtctcgaactcctgatctcaggtgatctgtctgcttcagcctcccaaagtgctagtattacaggtgtgagccaccgtgcccagccgatttttttgtatttttagtgaagacagggtttcgccacgttgcccaggctagtaagataaaagtacatgtgtgtaaattcaacgtggataaatttaagaagtaaatcccactatcgtagtttgttccttaatccatagaatgaagatgattaaaagagaagagattgaattttgttcacattaaagaaaactgttataggccaatttaatgtgaatctgccattatattttacattgatgatattgtcaattattaaaatgatgcctttgtagttgaaaagtcatgattaacctgtccattagcctgtcagcaaactgaactgatgaaatgtcctcataataaaagattcaggaatacagggaacagatgcatatggaaattacattaagcagtaattctgtcatttacaaaagttaggtttctctgcaacctaacagcttgagtacttgttagctacatcttggttctctaacttctactctttcctccctgcctcccttccactggtattttcggtaatatgaggtaggcactaggctgagaaccagcaatgcattggcgaataatgtacactcagaagctgcctcattgagcatccactccacttttggatatgtgtgataaatgatgttctttgttttgtaaaatagtttcttatgacagtgtttatctttttaaaggaaaaaggcaggcaactcaagttcagattgatagtcatttcaataataatgaaaagtttaagcttcagctatctaaaaaaattactgagctcagtgcagctacaggccttaatctgaatccctttgcttatctctgtcaatagggatattgtgaaaaagagaagtaataaatgtttagcaagcagtttgatatttacacccagtggctgcaaacagttattaaaagccattgcataggtcaggatagcaggttcggtggcttggccaggacgagggctagaagagcactgtctttgtggcttcaaagaaggagatacacgtgaaattattctactcttgataaaacattttcttattaaatgcttagagttaggattttgtctgtagatttctgtacacttcaaaacatcctgagaaattcaagtactgtttgtgaacacaagcaagttgattatttcttgattaggatattttatatacaatactatagattttaattccacttagtaaagacagctccctgacaaggcctggaaaggtcatttcgtgagactacaacaatcacaaccattcattgtgtttggaggcaagtattggggctggagtgggagttcctgtttggtgtgctgggaggattgttggacatgggaccctggttctagctgccttctagcctcagctctgcttctgctagctgaccgcctgaacttaaatcatgttttcctgtatcctttgggcattatttgattttaggcaaatcacttggcatcattttgcctaaattacttaaacatttttgagggtgttggactagatgctctttcagatcatgtccgattaaaaaaaatctgtgatttgcagagcaacagtagcagaaaaatactaagcacaataagttgatgagaagtatttagtgcttgtgcagcatttaggattttatggctaaaacaaatctaaattatgaatgattcatcattttaataggattttacaaggtacttggaatgggtccaagcattatatgtacttctaaaagtcaaggtttcattactaactgctgctgttgtttttgtaatccctcagaccccttgtgaagagagaagatagtacatattgggtcagttgttgagtggatgtgctgttaatcctgtgggaaaaaattacatgtctctgaaaatgctttgaacttttatctggctgaaaaaatacatttctaaatttgaagacaactctgagcagagaaaaactttatgaatcctgcatgatatgtttacaaattatttgagaaaactgcctgtgaatgtctttggcatgattgtttacccctagagtcccatatgtcacacattgcctgtttacccctggggagtaaccatattgcattatttgtgatcctttggagttgtatgaaggataatttaacttttcagatgtggttaatatacaggccctcattcctaactattaacatacatagcatgacaggcttaaatgtttccaggcgtgattgaggaatttggacattaaattactcttagattatcttggccattgtaatttactacagaactgcagtttgggcgtcaacacttgaagagagtatgttaacatgaacaccacttgaggcacattttacattaaataaattgtcttcttgagacacttaagtgtttattattttttaaaaatacagtttagaactcttgtcttttgagtgcttgaagttttgttaataagcaggccttgatttacataatcctgactgatgttgtgagacatttactgtagctggagcactctctctcctgctcatggaactttactccccccagtcctgcttttatccctgccctagtccagagaagccatctatctttcatccacttcacagaatagagtctcattttcctccagaaacagctcaccattaatcagtgcataagagggcccatttaatactgccgctgtttgcagctaaaatccttagaaatctagagagtttgttattaatggagacataagagaggctgtgttctattttgtagcggaccagaggaggagcagatgaggtgggcagaggtagcaaatgaggtgaattgaaagagaggcagaaggctggcttgggctgagaactgcttgctgttatagctctgtgggctgccgccccgcacactctgttccttacccatgtctatcttctctcaagcttagtacctaccctcaaacttccagtccccatctggtcttcagccattctcaaacctttcccacctctccacctcattcagtgggaggcactgcctcactgcagcaaggtagagagtcgatggattcctgatgccccctaattggaattctgagttttctcactgaaatgtttgtgctcatgccagttagtccttgtagaactgtaagtatactgtagtgctatacagttagaatacacgggtttaaaaggcttttgttgctggccatagaatacatagattaaaaaggcttttgttgctggtcctagaatatatagattaaaaaggcttttgttgctggtctggggtaaccttataatcatttatgacattgttcacaagagtgtcccaggttctaaacagtcaacctaaaatggatttttgaaacacatttttctagaaagattatgttttcccatggaactcatgttcaattgtcttctctttcacttttttttttttttgagatggggtcttgcttcatcacccaggctagagtgcagtggcacgatcttggctcactgcaacctctgcctcccgggttcaagcgattctcctgcctcagcctcctgagctgggattacaggcacccgccaccatgcctggctaatttttgtatttttagtagaaatggggtttcaccatgttggccaggctggtctcgaactctcctgacctcaagtgatctgcccgcctcggcctccctcccaaagtgctgggattacaggcatgagccactgtgtccggccttcacttttccttaactctgaattagaatgaaagcttcaagtgatactagatccttaatgaaagagaaagtagggatcttttgttcttagaatttcaagttggtcacccattttaaagtgctataaataatcactgattatttgatttttttggatcaactttgaaatggtactggtgtggaaaggttcatatattattttagttttttgtgaccttctaggaaggatattatgtatgacagaatggaacttaagaacctgaaaaggcataagtagaaattttacactgatttcatttattagaatgcaagtttttaaagggatatttgatccaaggcttcgaataaacttcagttctactattgactttgtcccttgaaactttttactaacctatggagttacaactttaggcacttgctaatgtatttgcaatgactgttgaaataattcaaatttattgaccataggaggatactaaatatttatctttcctgtttagtgcctgtagtgaaatagaatataagttaatggttaatggcttataggctattatttctgaaatactatcttcatgtactctatctagtggtatcatttatattttgtatgtgttaaacagcatatttggaatctaccttacataaattttgcagcttgggtaaaaaaaaaattccaggagagattttctaaccatgtagggatgtgtgtgtgtgtgtgtgtgtgtgtgtgtgtgtgtgtgtgtgtgtgtaattgcaaaagaagaaaagtgtgtaagtttgggctagggagaagtcctttttaaaaaaaaaaaaggtaatgtagtaatattataatgtgtattctggcactcctgcaatatctagtgcattctagaatgtctctgcttggcattaattcagcatgtgacaatctgtggcaagtatgttagcttagtattgggatgaccaaatgaaaaatgtgtttgtagatgtagaaccagagaaggaagctgaagtatttaatgcagtattaaaccaaaagcattttaacataaaagtaatttaatttgcattggtataaacattagagggaacaaaaggcaatatttttatgttttaaattttgagggtaataatttatagaattcttttgaattttctgaaaacttcaaagttgacttatgaaagccacttagtaagagaagctttgattttctacaggcctcaaaggactgccttagggtttattgttttgttttgcttcctgtttaattttcaagatgctgaaagtgattgcttattgtggttaatttaaataatccagatattttgaattttaaaactatgaggactttaatgtcattcatttgtcaaaacagataaataatttagaagtggttggttggctgaataattccttacgcatgtaatatcagctcatggaagtattaggtatattatcgagttctgtagtacagataacaaattttaaaaatacatcaaatcctagcagcattttttaaaagtttaaaaagtttgtttttaggagaaaagaatcctcagagctttttaattagttatattcagaagttgtcttagataaaaagagatgtgtattgaaaaagtttttgtatggaatatggcatttgcacaaaatacattgagtagacaacatggttttgaacatgtattattaaatggaatgcatttgagcattggaaaattcatcctaaggtctttcttttgttccttttgtatcttccaatattatggaagattatatagcttatccgttatattttgttacactaaaatttagaattcactcattaaaagagtataaacaagacagtaatattttaagtactaaataagagcagtcatgagtaatatttgttacctttgttaaaacaaaattcattgctgattaacaaagcaattaagttgcttttttccctcaggcatgcatcattgcaagacagttttaccaactttagttatggacaattaaactgtgtggctatgtatgtgtatattgaggaactaacacatttataaattggttgaggcagcaagacttcattgactgcccttgtagtgttggccagtttcatagaattttaactactgatttatttttatttacttaatttgttttgagacagggtcttgctctgtcacctgggctggagtgctgtggcacagtcatagcttatcctaacctcaaactcctgggcttaagcgatcctcccacctcccaagtagctgtgactacaggcatgtgctggcatgtgctaccatgcctggctaattttcaaagtgtttctagagatagggtctcactatatcaggtcttgaactcctgacctcaagcaatcctcccaccttggcctcccaaagtgctgggattacaggcattgagccaccatgcccagcctatttgtttctttttttttttttttcaactttttaagttcaggggtacacatgcaggatgtacagttttgttacataggtaaacatctgccgtggtagtttgccacacagatcatcccatcacctacgtattaaggtcagcattcattagctatttttcctgatgctccctgctacccccaacaggccccagtgtgtgttgttccctaccatgtgtccatgtgttcttatcattcaactcccacttacaagtaaaaacatgcggtgtttgtttttctgttcctgtgttagtttgctgaggatagtaacttcatgtccattcatgtccctgcaaaggatatgatcttgttcctttttatggctgcatagtattccgtggtttatatgtaccatattttctttatccagtctatcatgttgattccatgtctttgctattgtgaatagtgctgcagtgaacatatgcatacatgtatctttataatagaatgatttatattcctttgggtgtatacccaatagtgggattgctgggtcaaatggtatttctgactctaggtctttgagaagtcgctacactgtcttccacaatggttgaactaatttacactcccaccggtagtgtaaaagcatatctttttctctgcaacctcgctagcatttgctgtttttgactttttaataatcgccattctgactggcgtgagatggtatctgtctccttgtggttttgatttgcatttctctaaggatcagtgatgttgagctttttttcatatgtttgttggctgcatgtatatcttcttttaagaagtgctcgtacatgtcctttgtccactttttagtggagttgtttggttttttcttataaatttgtttaagttccatgtagactctggatatcagaccactgtcagaaagatagattaccaaatgtttctcccattctgtaggttgtctgtttactctgatgatagtttctttttctgtgcagaagctttttagtttaattagatcccatttgtcaatttttgcttttgttgcaattgcttttggcattttcatcatgaaatctttgcccatgcttatgtcctgaatggtattgcctagatattcttctagggtttttatagttttgcattttacatttaagtctttaatccatcctgagttaatttttgtataaggtgtaaggaaggggtccactttcagttttttgcatatggctagccagttctcccagcaccatttattaaacggggaatcttttccccattgcatgtttttgtcaggtttgttgaagatcagatggttgtaggtgtgcaacagttatattactgagttctctattctgttccattggtctgtgtgtctgtttttataccagtaccatgctgttttggttactgtagccttgtagtatagcttgaagtcgggtagtgtgatgcctccagctttgttctttttgcttaggattgtcttagctatttgggctcttttttggttccatatgaattttaaaagttatttttttttctaattctgtgaagaatgccaatggtagtttaatgggaatatcattgaatctataaattactttgggcagtatggccattttcataatattgaattttcctatccatgagcatgggatgtttttccatttgtttgtctcctctgtgatttcgttgagcagtggtttgtagttcttcttgaagatgtccttcacttcccttgttagctgtattcctaggtattttattctctttgtagcaattgcgaatgggagttcattcatgatttggctttctgcttgcctgtctttggtgtataggaatgctagtgatttttgcacattgatgtatcctgagactttgctgaagttgcttatcagtttaggaagctttcgggctgagactatggggttttctagatgctggatcatgctgtcttcaaacaaagacaatttgacttcctttcttcctatttgaataccctttatttctttctcttgactgattgccctggccagaacttccagtactatgcataatagaaatgttgagagaggggatccttgtcttatgccggttttcaagggaaatgcttccagtatgatactggctgtgagtttgtcatatatggctcttattattttgaggtatgttccttcaatacctagtttattgagattttttaacatgaagggatgttgaattttattgaaggccttttctgcgtgtattgagataatcatgtgttttttgtctttagtgcagtttatgtagtgaagcacatttactgttttgtgtgtattgaaccaaccttgcaccctggggatgaagcataccttgaagccaccttgatcctggtggataagctttttgatgtgcttctggattcagtttgccagtattttattgagggtttttgcatcactcttcatcaaggatactggcctgaagttttctctttttttgtatttctgccaagttttggtatcaggatgatgctggcctcgtagaatgagttagggaggagtccctccttttcagttttttggaatagtttcagtggaaatggtaccagctcttctttgtacctctgatagaattcagctgtgaatctctggtcctgggccttttttggttggtaggctatttattactgcctcaacttcagaattcattattggtctgttcagggattcagtttctttctggttcagtcttgggagggtgtatgtgtccaggaatttatccatattttctagatttttctatttcatgtgcatggaagtgtttatagtattctctaatggttgtattttgtggggtctgttgtgataatcgccttattatttctgattgtgcttatttgattcttctctagattttcttctttattagtctagctagcagtctatccattttattaactttttcaacaaaccagctcctggattggttgatttttttttaagggtttttttgtgtctctatctccttcaattgagctctgatcttggttatttcttgtcttctgctagctttcgggtatttttgctcatggttctctagttcttttagttgtgatggtaggttattaacttgagatctttctagctttttgatgtgggcatttagtgctacgaatttccatcaacactgctgtagctgcatcccagagattctggtatgttgtctctttgttctcattagtttcaagaacttgatttctgccttaatttcattatttaccaagagtcattcaggagcaggttgttgaatttccatgtagttttgtggttttgagtgaatttcttaatcttgagttctaatttgattgcgctgttgtctgagagactgttatgaccagttcttttgcatttgctgaggagtgttttattccaattacgtgatcagctttagcctcatttcttttacagaaacttgtatagtgtttaccatgggctaggcattgttctaaatacctttgttaatattgacttacttaaacctgagagcaacactgtgaaggggttttgactgttttcagtgttacagatggtagagttatacaagttacgcagaggctgggtaacttgcctaaggtcccacagctattatgtataggatcactattcgagtctcagcagtttgcctcctgaatttttgaccttaaccactgtcctctgttgcctattcagaaaggtctctcttggaaagttgcgtccaaattctttcctttgtgagactctttcctctcaagctttttctgaccagacaagggaccttgggagggacatgttggcaggagtttcttacattcttgctcttcttgatgtttgggaggcagtgtggcagctgtgttacaccacacacacacacacacacacacacacacactcctcagcagtgctgggtaggctaaattgtgtgtacaaacacttagagttgtcaattatcagtccataccaggtattcaaaaacattaatgagtttattttggcactcaatttgttttgtgagtgctcctgctccatggcatctttataaatataaacttgtctccgtcagtatatatatttgtgggacacctattgtctcttatttttggctattttggaagatgacttttttccattgtggtgccctagtcctctcccctcttcacatggcccctccagagtggacacctgtgttcacagcaccattatttacaatagtccaaaggtagaagcaacccgggtgtccatcagtggatgaatggataagcagaatgcggtatatacattgatttggttttgcactgtgtcccacccaaatctcatctcaaattgtaatccccacatgttggaggaggggcctggtgggaggggattgtatcatgggggtggatttcccccttgtagttcttgtcatagtgagtgagttcttacgagatctggttgttttgtggcatttcctccgttttctctctctctttctctctccctctctgtctctgtctctcctgccaccatgtaagatgtgccttgcttccccttcaccttccaccatgattgtaagtttcctgaggcctccccatgaggaactgtgattcaattaaacctcttttctttataaattaagatacttctttatagtagtgtgaaaatgggctaatacgtacatataattaaacattaattacctttaaaaaagaaggaatttctgatacatgttacaatatgggtggactggctaagtgaaataagccagtcacagaaggacagatccacccatgtgtcacataatgatttttcagtcagcgacagatcatatatacgacagtggtcccataagattataaaggtacttaaaaattcctatcatctagtgccatagccatcagtatgtcttagcccagtgcattactcacatgtttgtgatgatgctggtataaacaaacctaccatgctgccagttccataaaagttcgcagtaatgtcataggtatccctgttcactcaccactcactcactcactcactgactcacccagcatcttccagtcctgcaagctccattcattgcaagagccctatgcaggtatataattttttaaaaatcttctataccttaaaaaaaatgtttcagacagtatttttactgtgtcttttctttgtttatatatatttagagacacaaatgcttgccactctgttgcagttgcccacagtattcggtacaatggcatactgtacaggtttgtggtctggaagcaataggctataccatatagcctcggtgtgtagcaggctccaccatctaggtttgtgtaaatatgctctacaatgttcgcaaaatgatgaaatcacctaacgatgcatttcttggaaggtatccctatcattaattgacacagactgtagtgtatgattctactcttatgaagtacctagagtagtcaaattcatagaaataagatagaagagtggttgccaggagtagggagcaggggtgcgggaggaatgagagttgtttaattggtatagaattttggttttacaaggtgaaaatagtcctggagattggttgcacaacagtgtgaatgtgcttaacagtaactaaactgtccatttaaacagaatcatggcaaatttttgttatgtgtgttgtgtcacacacagaagaaagcccttcagatttggtgtaaaatctgtttagctgttgtagtgtgttgcttcagtagacaaaaagacaaaaagacaaaccagctcagttctgcttttgagatgacacacattgtggtacctgtgtgaatgtgtttgtatcaattcagaaaaggcctgttgtggaagttgaagaaagggaaaagccagtatggggggcagtgtgagcagagatcatggaagcagaaatgaatggaacatgtctagggtgactgagaaaatggtcatagggagagatctttttttttttttttttttttttttttttttgagatggagtctcatgctgttgcccaggctggagtgcagtggcacaatctcagctcactgcaacctccacctcccaggttcaagagattttcctgcctcagcttaccaagtagctgggattacaggcatgcaccaccacacctggctagtttttttatttttgtagagatagggtttcaccgtgtcggtcaggctggtctcaaactcctgacctcaggtgatccgccacctcggcctcccaaagtgctgagatcacaggcacatgccactgcgcccagccaaggagagagaatctgaccagagcaaaatgaatattactaagagctggtatcagtctccattttttcagtctctactttttgataattgaagtttggtcattttgtttatatttcatttctcaccacatctatcaggtagagtatttgatgccttttgccaaggatcatttcagggaatgctctgcgctgtgagttactaggattgatgtaaggataagtctacaacccccttcccttagaatttcatgctctaataggcaagataagaaacgtggaccagtataactaaaatgcaagacagagagtcgagtgatatgcagtatcaagaacgttgtacatagactagagagatggagttctcagagggaagaccagggaaggtcctaaagaagtaggagcggaactttgaaagagaggaaggatgttaataggtagagctaataaaggtatagatccagggtgagcacatgacacagaaagatacagggaaggcttaaagtgtgggaagacagtgcattgacaccatcagaaggtcaagccaacagatgctgtgttaggaagcatgagggttgatatatgggccattttgtgattgttcagtgatacggctgatttgattctttggtgtccatctgaagtaggaaattagcttggataaataaataaggaggatataaatttggccttaaaagttaggcataggggttaaaatttgattgagttcactatatagagctattgaaagagttctgagcagagttttatcaggtaggtagcagtatgtagagtgaattgtattgatgagaaagactgggtagttcaaaggctattgaagagtgaaaagcatgaagacctggactagggtagtagtagcaacagacaccaaaagaagagaggattaacctgaagtagaagaaatagtggaaggaaggaaggagggaaattaacaactaagatgcatattttatttgcaaagcatttattgcttgacattaactggccagtgttacccactcttagagaataggtatgtatattgctcaggcaaggggcattgtcatgtaacagtctgggtgaagaatctttgttagagcaagctgatggggagggtcttggatggcttttaggactggtgaattgacaagtgcaggtagtggtcaccattaacgtgtactgggtttgttggctgtgtccactggtgtgcctaggccagtggttctcacccttccatgccttgataaatggcaaattctgttaaattttgaaagtttgtgttaattttttgctgctgatgtgtattcatgtcgcccaacagagtgtgaaagagaatctaacccagcaggttattcatggcagtgttggagcaaggcaatgattgctcttaagaagcaagaggcttaatctctaggccagtgcccagaactgcccattgctggcagagttcaggaaatgtacttcaatagcagtggctgctattgggagtctgggactgatgcagcttcagggtgatgggacagcattggcaccccaaggtacccatcggtgtaatagtgaatgcttaggaatactctgggcatggttcagtttagatgtgggtttttaaattcattcaggtctgcccaaaaaaagtccagtctttgaacatgccctgcaagcagttggaaaagaccggtccagccagctctttgataaatgctgcaactacataatggggtggatgaaggtagggtgaaaagagaatggaatttggaaaatgaaatcataagtttgaatccttgctttgccactatcattgagaccccaggcaagttatctcagaaactgagaaatcccagtttttacagtttctttgtaaaatgaaagtaatcatatttacctttcaggcctaatctggtaactgtagttaatgactataaagttctaggcattgtactccatgaataaaaataatttatttcctgtctccactgtgggatgacttcagtgctttattcttctctgtattaagcaaccacatcccagctttcgtaaagcatgtgtttctctgaactatggactcctggagtttgatctttaaagattaaataggcttagagtagtcaggccaagaaagcaagtgttggtcacttgtgaattatttaaaatggaaaaaaataattagatataagcatcaaaatttgctgttaaaaatctatttaaattgtaatacatctgaatacacagtcatacacattatgaagcacctttaaaaaaggctccacttgccacccccacctaaaaacagcaacagcaaaatttatgactaaaatagtcaaaggggattttggcagacttttctatcaacttccacagaaaaagacccattttcctatttagaattaggaagaagaagttgggaaaatgttttagagcagcgtagagtcagaaatatcatattataatatattgtagtattgtggaacatattcaagtgtaggtagttttcttttaattattaagcatagttttaaacctgcttacaaatgtagccattttaattcacagtgggctaaacttggcacagatattctctgctcaaacacaaatgtagttgctttttaactgaaaaagttgacttgctcctttttcaaaattcctagagatttaaaaaaatgtatttactttgtccagttttagctacaagcaatggtgttggcttcttccccaaccacttctaattcaagttactgtttactatatacttttgtttttagtaaaatagttgatttacaagtcttaaaatggcttctctcatcgcatagtgactgcttttcataagtattgtttttgaaaccttaataaaggagcgcatgtaacatgaatataaaagaaaatcctgttgaccttgagggtactttgcattctaacattttcagcatctctattcatgtcatgatgtaagtcatgttttattgtttaaaagtgtagtttgtctatgtatgtgaaaaactgcatttattcatactgcctttgctgggactgtaacatcttaatgattttattttgttcacaatatgtttgattgctccttcactgaatatgagatttttgctttagaaaatttaaatgtaagcatttaaagatacagcttaaatgaaaattaaagcttagcttaaaatgaagttggctaaagtctgacttttactttgatttctctggtcgtatgcagtttaatgccagaaaaaaaatgtagatctaaaataacatcaaaatgttagactttttagaagtttcacataaattaatacatagcattaattttagacattttaacgtaaggaatatctgttacttgtagctatgaactcttaggcaactgaagagatctgtaaaaaggaaaaaatctgtaatttaatacagttttagcaatttaaaaattagcttaaaatttgtagtaccattttatatttcagcaagctaaaattttgaattagagtaaattcaaggacacataaaagctgtattaaaaatttaaagactaaaatgattacttttctgattatgtgctatactctattgtgttgttttagtttgtttgttttagtaagaaagctttatgctgttgtttctatgtgccagaaatgattagcaggtgacagttttactcctgatcattattgtacgagaaagcccagtaaagaatatcttaaaaatatcatacatttgctatatatgtaaatgtagaatttgctttttttttaattaaaagctgtaccatatgagcatttcaggatgtaaataaattcctcctccatgttagaactgttttctttactgactgttcttaagtaagtgggagtacgggaggctttaaaatgaattagctaattgaaagttcttatttaggagagaaatattatatattaattccttatctatttgctttgcatagctgccatttccagataactgaagataaccagctcgtaggtgttagaattgcttttattttatttaaccacttcaactggaaattttttctaagtgtattgcacacagccatactttttaagattgcgtaagcataacctgtctttttcttgtgactcagtaaatactgtgcacgttactttttgttaacttgtgttcagcattttgcttttgtactatgacataagacttttccaaattttaatttctggtatctgatttttttctatgactgccagctattgtttttactaattgacattcatcttttttttgtttgttttttggggttttttttttttttgagacatggtgtctgtgtcactcaggctggagtgcagtggcatgattggagcctactgtagcctagacctcctgggctccaacaatctttccatctcagcctcctgagtagctgggactgcaggtgtgtgccaccatgcccggcttatctttttattttttgtagggacaggagcctctctatgttgcctgggctggtcttgaattcctggcctcaagggatccctctgcgttggccttccaaagtgttgggattacaggcatgagccaccgtaccgagctcatacattattccactgtgttccttatttgaagcaaataagaaaccagatcatcatcatcatcatcatcattatcatcatcatcatcatcatttattgagtgttttataatcttcatatcctgtgtcaaagtcattattcccatcttgtactggaaaaaaaaataggtttagataggttaaataacttaatggaggtaaggcagttggaagtggtaagatggaatatgactcagatgagtttttctatatatataaatatgtatgtgcctttgtaaatactacccagatgaaaacaggatatttatatcactccagaaggttccctctcctgtgctcttttccattagtatttccccagagataaccgctgtggtgaccttggtccctataagatagagctctgttctttgtaattagttttacctgttcttgaactttataaaagttgaatcatataagacgtacttttttgtgtcaggcttctttgctgtgcattgttgcatccatgagatttctgaatgttgtagtatatagcgttagtgcttttgtttacattgctttgtagtattccattatatgaatatattaatatttatttatcctattgatgaatacatcaacatttgggtcactttctattttggtgttatgaataaagctgctgtgaacattcctatttgtgttttttgtggacatgagccctcacatctcttgggtatacccaagatcaaaattgctgagtcttggctgaggcatgtggactcacacctgtaatgctagcattttgggaggtccagttgggaggatgacttgaggcctggagttcaagaccagcctgggagactccatctctacaaaaaattaaaaaataaaaaaggtcagaaacagtggcttatgcctgtaattccagcacttggggaggctgaggtgggtcgattgcttgagcccaggagtttgagaccatccacatggcgaactcccatctctacaaaaggacaaaaaataagccaggtgtggtggctcacgcctgtagtcccaactacttaggaggctgaggtgggaggattgcttgaacacattgggggctacggtgagctgtgatagcaccactgcactcctgggcagcagagtgagaccctgtctcaaaaaaagaaaccagaaaacagtagccaggcatggtggtgtgcatctgtggtcctagctccttagatggctgaggcaggaggattatttgagcccaggagttcaggctgtagtgagctatgatcatgccactgcactccagcttgggtgacagagtgtgagatcctgtctctaagaaggaaaaaaaaattgctgggtcttgagaataaagtatattgagctttagtaggtactaggtactaccaaacagtttttcaagtggttgtatcagtttatattctcatcagcaatgttgtggaagttctagttgctctgcatcctcattacttgttggtattgtcctattttttctctttgtttttaattttatttattctggtaaggtatctagtttgacaccagagaaatgcaaatgaaaagttattttttaacatgaaaaaatatttaatgtgaaaaatgtattctgtgtgtacagatgaataggtgtgtacatggtcttgaaccttgctgagtttttttcctcttaacctcagtttttataagtgagccttgattgcctgcttaatcactgatattaatagagttcttctataacaaggacaagttcagtattctagaaaccacttgtttagtttagaattttatttaaggaaatttattcaaggaatttaagatggtaaatgtctattcaaagaatccagtttatgaatgatgtctaggagacctagagaggacaagaaaaattgtacccaagaatgtcacaaacttattgcgtagaaacatacaaattgtcttgtagaagaactgaggaaagacctttacagctgaaaaataatcggtttctttcactgaaatatagcaggtacatataatctataagacttagaattgtattcattcgatggtttacataatctcatagctattctgctgaaaagttcttgaattgattagttcttggttttccaagttcagtgccatttacaggtcttcaacttttctgtatgtgtctcaggtacgctgattagtcagacggtctcatctgaaactaatgtataatagtgctaagttgtgtaacttgccataccagttttacagtgtttttgttttgctcaaagtagatgaaaggtttatttaagtgtggccacactggtactgcattcctggtgatcttggtaaggttaatgacaatctttgtcatagaaatcaggaaatgtgggttgagcctctgggatgcatgtagctggttcgttaaaatgctgcttcccaaaggagtggagattgttggaagctcttggtaggtaatgtagctttaaaaacccatctgtctgtctgtctgtctgtctctccatctatctacattcagcttttttaaaactctcttaatacatcagtgtttaatcataatatctactgtgtgattgctttctctagtaacattaaaaaccgctttggaaatccaggtcggtttttttcctggttttgttttagttggagtgttttgattagtagtgatgatggtcatatagtgagattgtacttgtactttaactggttgacttttaactacattaattttgtctgttggtattctgatttatgccactgctatttacttttagaaggtggattgaagagttgcttaaaataaatgtctttgaaacagaatcagttaaagcaattaaagcagttttggtactcacttaactttgaggtatcctttggacaatatttgaatggattatattaatgaattttgcaaaaatttcaggcttctcacaaatgtataaatgtaggcatgcatttatgtgcagagaatacatactgcattcttgctttctgttgagtatgttgttaccaggcacactttacttaatttgtttcagatatattccttaatgacattattcaaaatgcaaatgaatacaaggcaagattgttgctcatttgaagatttgttcatttcaagacttttcatgtgtgcctatgttttaaggaaagtgatgacagaagccgaatgtattaatctcctcgagcaaacttcaagaatatacttaatcttgaatatgaatggaaaactttgaagttaggcaaggaaagcttaagcaaaggcagtgaagtgagttagtggctggtaaaggactactgggacaggactgagtgaagttaagattgtccttagtgtgatctctagagaagctaggagataagttatgtattagaaccacagtaaggtagctgaggcctttaattttttaaaagactgtttctgcattttgtaaagttagtgttgaatttagagactatttccaatacttcaaaggctaaaactaatgaaagctgaatatatctcattacattttctgttcttctttatgcatctggatgatcatgaatattgagttaccagtatgtctaggagtgaatctgtataatggtcaagtaaactttgctagcttttgagcttgaaatcttcaacactggatcactggaggccgtgaccaatgatctccatgatttgttatatatatatcatgtaagaaattaaaaatttgctatcagttttcctcatgtgaaccccccttgttttatattttatgaaagacatgtcctccaaattactttgttttctgtataattttaggaatcacagctgtgtgtgtgtgtgtgcatgtgtgtgtgtgtgtgtgcacgtgtgtgtgtgtgtgtgtgtgagagagagaaatgcagaaagggtagttttctgtcattttatttgtattaattttattgctgtcactattttgaactaacagtgaaatgcctgtatcctttcacatgtatatgggagaacttaataaaggtaagagcatatgtactttatatacatatatacacggacttatttatgtgatggtgacttaattataaagggtaagaggatgtatacttcatacatagatgtacacagacttacagtttatattacatgtagtagactactttgaaaatagtattaattgaaccatatcatgggtactaggaagaattgacaaaagtgtttatatgattaagaactgtaggagttttggtggaagcctattaaactgtaactcagtgtttttggcttgtcttgccagttgtgaagaggtgaggagtagtgcaggctagtttcctagtggcctcatttgagctgcctctgctattagaatggtaggtgtgtcccagggagagcagtcagctacttagaatgttggtggtaatggccttcatttgtgaggtgatgaggttagagatgatgaagctttggccagaaagatcagaatggcagaccaagtaaatgggccacccatgtgaaagattctgggggatagctagatcccattttagcctcgataaagaacagacaagattcttaaatgaaaagtataagtgaaaacttgcagttaagatgttattttcagccaggcacgatagctcacgcctgtaatcccagaactttgggaggccaaagtgggcagattacttgagtccaggagttcaagaccagcctgggtgacacggcgaaatcccatctttacaaaaattagctgagtgtggtgatgtgcacctgtagtcccagctacttaggaggatcacctgagccagaggaggttgaggctgcagtgtgccgagattacgccactgtactccagcctgggcgacagagtgtttaaaaaaaaaaaaagatgttatgttctactttctatttattaaattagtagaatgagtgaatgagtgagagactgccctttgttaattagattgtgattgaaagagcattttcaggaactagtctttggtataaattgttactacttttctgaaaaaccactttggctttgtatagcagaagccttaccagttgagcatatcttttgaccaaggaatgcctaggaaataattatataaccagacgaagatttgtgttcaaagatttctgtcatacagtttctgtaaacagtgaaacaatggaaacagcactgtttaacaggaaagaaatggttaggtacatgatgccatattcttaagataggaataacagtaatggtaagggcaaatagctaagtagtaaattattatgtttaaagatatggatagtaaaaacatctgaaagaaataaattaaaaaatattagctaaaatactaagagaagttacttcatgggggtagagatagtggtgaatatttcttcctctcttttatgctttttttctatttttcaaaatttccaaagtaaacataaaaaggaaaatttaaaaagatcagagtgaatgataacttcattaaagggggaaaggtagaactgactgcatttgaaatagttggttcagatatgaggccacgtttggaaacagtacctaatatcttgtctcttggaacaagtcccaaggatagcaaaatcttcttggaatgagtaagaaagggttattaattttcttttaaaggttgttgatctatagagtttatcctatatgagtacctttttttttttggggttggacaccatggctcgtgagcttttgggaggccaaggcgggtggattgcttgaggcaggagtttgagaccagccttgacaacatagtgagaaccctgtctttacagaaaataaattaaaaattagctgggtgcagtggcacgtgcctacagtcccagcaacctgggaggctgaggcaggaggatcacttgcgcccaataagtttgagattgcagcgagctttggtcacatcactgcactgcagcctgagtgacagagcgagaccttgtctcaaaaataaacctaaaaaaaacaaagatattaatacaacttttttatatcctctggcacctggtacttgatgagttcatgaggaactagagaatgaatgaatgaaatttgcactgcattttggtcacaaattgacaagatgtctccatatactttagggattagatagcatatattgataagatggagaaaatagagatatttggagtagaataatcaccagcttacttagtatattttatcctaacatgtgtatcctaggcatatacatgtcagtcttgaaaaatgaagtcctttattaagacggattttcagagggagagaaaaactagtagcagaaccagttaaggtggtatgtgggaccagtaatgggtaggggaagggctgggcctgggaaatgggaccccagactgttcagggaagcatgttcatccccactgaagattaggactgtcctggaaataccatgttaacctaccatatggtattggatagttgtgtttgtatatacatattattctttaaattttggatctttttgggagttcattttaaaaactattttttttctagaaaaccagaaaattagcacataggctcataccaggtgtcagaaaggttattggagatagttgggtagatagtatttattgagtgagacaatgttataatcatataatcagtagtctgatttacacatcgtttatggtaataagtatccccaggcaataatctcccccccttcaataattagcaaaggacttaatgtatcaaataattattttttaaaaaaattttgttaaatttccagattaggctgttagcacccttaatatcaatgacctttttgaagtttgctaattttttttcctacctcagataaatctgcttttcactgtcagcattacttatgtttcatcctgtgttcgtgtgctttctcgctgttgctacattcaacatccaaattgtaatttatatttataactgcctctcatctaattatattctttctcgtttttaaaacacagcaaaatcaactttagctagccattatactaaaacatactacattttcttttaaacttcttttagtttgtttcctctagatggtaaactctactcaggcagggattatgtttgattattgatgtgaatgcaactttttagaacatagctgcgtactcagtggactcagtacatactgaccagttgttgaaaaatctgatgcagcctccctaagtgtttagcatagccagagtagtttacgtattcgttaaatctgactcagtaattagcagacctagtgtttaagtactggggaaatacctgcttgcctctcacagatgtcaagaaagtacctggtagaagagtcttacgacacagcctaacttgtgtaggacagaagataccatctggactttgtagaacccagaaatacaagtctaaaaatatcttgataacaaattctttgaaatatttttgaaggtcctgagcacttcacttttttggctatattattaggaattgtttgatctctgcaatttcaacaatgattacagtaatcactgtcattatcaagcatttactatgggccagaccctttcctaggtactttacatacaatatattgttctgttaaaaacttaacaaggtttgtattattattttacaaatgaagaaactaaggccgagggaggttaactaacttgcccaggatcacacgtatggtaaaggcagaagtaaatacttgagatatggtttgttgagttctaaaacttaggtgaattttacctcctaatacgtctcaaggatgtgggtactggaggaagaactgtactgaaatccaaatatttggtgctagctgttttgtataatactagtaaatattcatattgcccttatggtattgcttatgatcatacaataattggttcttgcttatatagaaatctacagttttctgtagtgaatatatgtgttacagcaaccacaactatttatctgaaatatcagtaaatatttatcataggaatgaacatatattaagtcttgacagagctctcgaggcataatgacttggttgaaagtagcagatttcagtaagaaccatgccaaaaatattaagctataagttattagtgtacctagttttaatggcaaacatgatgattttcttagtgccatatgatgaaataaataacttactagaagtttgtagacaggtttttttttccccctctggagacagagtcatgctttgttgcccaggctggagtgcaatggcataattttggctcactgcaacctctgcctcccaggttcaagcaattctcctgcctcagcctcccacgtacctgggattaccatgcctggctaatttttgtatttttagtagagatgaggtttcaccatgtttgcctggctggtctcgaactcctgacctcaggtgatccccccgcctgggcctcccaaagtgctgggattacaggccacctcacctaggctagatagttttattcacttggctgtttcaccaaaaaaaaaaaaaaaaaaaaaaaaaaaaggtatattctgaaacttaggaaagcattacctaagaatcaagtttataaataaaatatattcttgatgaaggaaaaaagcaaagcatttctgatatattagaaatttcaaacctcataggaaagaatgctgttttgcttcttgtgtggcgaagggtgtcttagtaagtctacttcctctgtgagaaagaaaatggatgtgcacagcctgcctggtacctactgaaatctcctttggataaataatttctttttcaaaaattttaattttgtaaattggcaatttgtaattacatacttatgggttacaaagtgatgttatattttatgaatattggctgggcatggaagctcatgcctgtaatcccagcactttgagaggctgaggcaggtggagtgctggagctcaggggttcaagattagcctgggcaacatggtgaaaccctatctctacaaaaaaaaaaacaaagtgatgttatattttatgaatataatgtggaataattaaatcaagctaattaacatatccctcattttgaaaactttatgtggtgagaacatttgaaatttaagaattttgatgtgtataatacactgttgttaactatactttccatgctgtacaatagatctcaaaatgcaaaacaatagaaaacccattgaggctttccaggggcctagaagaaaatcccaaagttaatttggagctcagaaagttaatttagaatttgattttgggaagcttgtcaaaattattgaaggtttaaaacacttgatcaaaataggatcacaggtcactgcgaaatagtagtcattcatttaatcagtgtgataataaaaggatttcaaaaggcaaatacagaaagttatatatttgtagataaaaccttagttctttaatagagataactcataacacttactaaagacaatatgcacagtgaatcatactgataaaacacagaatccttgttttcgagaccagttacctaaaagataaaaacctttcattattttttattaagagcagatcaatactcctccaagaaaaccttttttttaacagagtatcagattacctgttttgtgttagtgtattttgatatatatgctcagtttttagaaaaacttttaatttccttgcaattttagccagtttgattgcatgtaaaatttcttttgcaagtttcattttccacaaaccttttacaacccttcttatagcctatgctttttattcatattggaacaaccagtcactctaggacaaaaattactatctttttctcttaataaaaccatatctttcatgtaagcctgacttaccaaaaaaccacattcctttccttgcataaagagttttttctcttatttctagttttaattatcatatagtagagtttttaacttagtgattttaatttatagagaaaactgaggaagtaataagcagttgtgagctgttgtgtatcagcattttgtagatgagcactgtttcaaaatttttagaacactttttctcataatgtagtttcttcatgttttttttaacagacccagatatatagcttccatataaaaacaagatgtcaaaatacatatactttaaacttgtattcagcaattaatgtttcagcattttaacttacatagaaatgaggcagacatttcatgaatatctatttaagatttcacgttactgcaaaggaattttaaaattttgaaaagtgaatttataaacatttatactattcacattcacctaatttattcattcttaatagttatgtttgaattgctcatggaaaacaaggctacccatcatcatattttttgacaaatcggacagttaaaaatatcacagaagcaaagaaaccaataacttaaacttggtttttccctcttccttttacctccatgtctgacatgtatcaagcaatttattttcatgagtattctgcaataagcttggatttatagttttaaggtcttaaatatctaggagataacaagcctgtttgactagtaaaactaggtttaaagaaagtatgcttgcattataattgatgttagcaattccaaaaacatttttaacaataattttaaaactagctttatttaccaaagattatctcagatcacctgaagtaaaagacattagtttctgttttctgagagaatatttatttaagcatcactttttaaaagccagctaaatagagcttttatttatttatttatttatttatttatttttgagacagggtctctgttgcctatgctagtgtgcagtggtgtcatcacggctcactgtaacctccacgtcctgggctcaggtgatcctcccacctcagcctcccaagtagctgagaccatggtcctacaccaccatgcctggcaaatttttgtattttttgtagagtcagggtttcactatgttgctcaggctggtgtcgaacccttgggctcaagcgacctgcccacctcagcctcctaaagcattgggattacaggtgttagccaccatgcctggcctaaatagagctctttataaatttcagaaacatcatccaaggtatataacatgcataatagacatacacaaatgtacagatgccagtttcccaatagtttctctccctgtttcagattatccgtctttcccgtttcattgctctagtcagttgttagctaggcaaccctaaatttgtacttggaaaggcgtgaatgttaatgtggaaagtttacttctcaaaggcactgggaaaaaatggaagtttttttcaagaaagagcttagggcgtattgccttttgtcagaggtcaatggtatagagactgtggactaaaatttaggtctgaatatctccagagctcatctgggtggacaaaacacccattttctgctaaaactggatacagtgtattttcctatgacttggtcttgagatttctgcctggggagtggctgtaaactgtagtcctgccctgatgggcctattgagatagcccctccttctttttttttcttttgagacagggtctccctctgtcacccagtctggagggcagtggtgattacagctaacggcagcctcaacctcctgggctcaaatgatcctcccacagcctcccgagtagctgggactacaggcaggcgccactaagcccagctaatttttttggtatttgttgtagagatgggattttgcctagttgcctaggctcacctcaaactcctgggcttaagtgatctgccctccttgcctcccaaagtgctgggattacaggcatgagccaccatgcctggccagccactttttaagagcactgagcaggaggagaattaggttcaggtgtgtcagttagggagccacagaggaggattcaaaagatatgctgaggcaacaaaaagccataggaattcactgcagaattttacaaggaagtacacagatgagcctaggagaacattcagaagcctattcaaaataaccgcctgaatgccagaaaggcgtattttggaaacaaattttgttaggtggcttttcagtttagcttctgtttcttcactggcttattgagttccaggtggggcacattaacaaatagggctgattaagcattatgactgcactcagcatggaaagctctgaaaaagaagcaaaccggcttgacctgagggcctaacttttataagactttcccaatgttcctttgtttttgtggtgaggtagtaactaagtgaaatggcctgcaacttgaatttttttgtcaactagttttaagtgtttcattttccttttgtaaagtgtcttaaaagtggcaataaacaattttttttgaaaacttcatttttttttgttttttagagacagggtctcactctgtcacccaggctggaatacagtgacatgatcgtagctcactgcagcctcgaattcctggcctcaagcagtcctcctgccttggcctcccaaagtgtttagattacaggtatgagccactgtgctggcctgaaatctttttagaagcttctacataccaatagatgcccctgggttggcctgaattaggactccttatttttaaatggacttcttaaagtgcagtgctgtttatctgaaatgctccatgtaatggccattgtaattctaaattatctttgttgtgattttgccatttttgccagtattttgtagcttctgggacctaacacttactcatataaaagacaggtttatccagaaggtggagtacttagttctttagaaattaaggatctcattttttatgttgaatattggatctctcaaatctgaggtaaaagcctaagagggaaatgccacagtgttgggttgtgcaatgcttttggtgtgccttcttgtgcagatacttcctgaaggtggtggcactgctgtgttttgtgtccagtttatcctctcacgacagtcttattttttcatgtctggttaatctaacagctcttaagtgcttgaaccaggtccaccagtcaagttgtgacttttggcactgggatccccttgactgactagccagtgatttccccctaccaaagcacacaagaaaaagaaacaaagaggatagaatccaaatctttgtgaattctgaaacctggagatcacaccctctgcaatcatagccactcattgcaaccgcggtacattgcctttaaaactgtagctcttgctagccactgcaaaccccaagagttcatgtgctctcttatagcacaaactaaccctgagttcaaaagccaaaactatccaggggctccacgcagagatcagagtctgaaccgtgaggaacttacaaccttccgaacagtgtgaggaagacaggggactttaaaagaggtgggcaacacctctcctgcattccccatgggtctcgggcgtcatcagcagtgtttttcaggtcccactgttggacaccagaactaccaaaagacaaaattacaagaagtttagttatagatttgattggcttttattttatttaacatcaggttacttcggttactttctggtaagggttaaagcacaggggacttccttattacactggctcaggaagactgtaatctcccattttcagaaaaaaactgatctgttttgggatctatctcctaccttgaagtttccgtttggttatgtggcatagcatgagtaattccagtttggtttggtctggtctgttgggacctagtgtaggagctcagtccaaaacaacggcctcccataatttttgtttaacaatacccagaagtgggattgctggatctgaatgagtaatttcttgaatgatctggaaacaaaaccagagtgctgttttagagagttctatcgggattgagatgaagtgtttggcatttgtgtaggaaggtgtctggcttcttggagttggttgaggtagtatcatgagggacactcccaggacttggtaaaaacatagtgcctttaaaacagctcattgaacaagtttgagccctcataaaccagttcagtctccaaatctaataagactttgctttcagccatatggtgctttgactcgagaggaaacgagactcttaatgttcacacaaacatagtttatttactgagagcagatttttcatctaggcataccctctgtattgtttctgaaggtgatgctgcattttccttaccttatgcatcgtgcggatgactctccctagaaagcatgtactgcagtacttcagctgtttcatcattaatggaagaggctcacattcaaagcagtgttcctttaggaattttctttagaagttccgtcatctattaattcctgcctaccataatattataccccagcagggcagtgtttcattggaatcagattagggctcaattcagtcctcagccctcctgatttctctatcttggttcctctctggaaggctctcagggccgccagccgtgtggcctgtttgaaagcattaggttgtggatgaggcttgtggcaggaatgtgggtttgctattagtgttgcaaaatcacttcttatagagaatggtgccttcctcctgcctcctgcagtctggttttagattatttttcttgtggttttggtttgtgagtgtgtcctcatggctttcttttcctttattccttttccctttgttaacacagatagggaagaaaagaataagcaagagatacttctgtatttgtttatagtgtcaagttttataggcgacttcccctttgtcttgtgtagtataaggtcagggtagttaaaatgtttggaatcatttaacttactttcccagtaatgcttttattgttttggtattaaatataagtattaataatatggttataatttagaaggcgtggacatgaaagaatctatccataatggcgtcatccatacacaaccacttttagtgttttaatgtattttcttttgggtctctaagaggttattctgtttgttttgttttttaagtgtttttgctggaaatgaaatttcataggttggaattttacctcattttctcaattctttctttttcttagaggtgttgaatgcccaaaaagacacctgaaagaaaagaggaagaaatcaaacatagaatgacttttgtatcatcagcatcatcaacaagctagatgatcatccctttataatcagtgtcaagtatcttacttgatttctgtaagacataggcaaaaagtgattgtgaggcacagtgcattgccttccttagctcgtcaaaacttctttaccttccagtattttattgaacatgttggagatttaggacactcaaataaatgaaaaggctcagatatgtaggagtgagtggtatcaacccacatcagcgtttatcatttctgccttcctgctagataaaatgaataagttcaatgaaatgtctactagaaagcattgattacatagcacacttgcgtttctcttgtaggccttaggaaacatggttcaattctcaattcattatataactgagaaagacaacagtcttgttcacacatacaataatacagttttaatattctaaaaaagcatagcagttgctgaaaaacaattttggaatgcttaaataacaatccttttcattattttttaaattatattttacatttaggaaatgaatgctgcttggtttcatatttaaaaaacatttcaaaaccctcacttttcaatgtttcagggattttgttctagtttaacaatctgcagagtgtaaatttcttgttatatccatcatacaggcttattacatcatggaatttaggcactggagatggtagttcaatttttttaatgtgaccttccaaaatatgctgtttgttattgtttttgtaagtagtttagacataattccttaatctagcatttggagtctaaactcacttgcagagaggtcactttatataattttagtccatagatagaaataggataatataggttggtgaagcatactgtactttgatgcctttatgagtctttgtggcattctgtactttattttaaaatatgacttactcatttatttgtggacatgacagttgcttttttttttttttttttttttttttttggagtcagagtcttgctctgtcgcccaggctggagtgcagtggcgtgatctcggctcactgcaagctctgcctcccaggttcacaccattctcctacctcagcctcccgagtagctgggactataggcgtccgccatcatgccaagctaattttttgtatatatatatatattttttagtagggatggggtttcaccgtagccaggatggtcttcatctcctgacctcatgatccgccctcctcagcctcccaaagtgctgggattacaggcgtgagccgccttgcccggccagcagttgtttttgaagtttactttctgtttatggcctggttaacagatcaccttctgaattataaaatggatataatagggggatggtggaggaagtggggagaaacttgtataaacattttaaggattaggaagtgactgaaatatctaaaatcttttagccaacactgagtacttctattcctaaaaattttttcgtgtgtgtaccttaaaagtaaatatataacttactctgttgttaattcttccagttttaaacagaaatttgatttgtgaattacagaagcataacatttcatatatatgaggtgaagggtgaggtttgagactagagcccacaatttcttattttctcaaaataactcttttcagcttcccgagttaccactattaccagtgacaagtcatacctctttgcctgaagtggtaagttataccacttctaaaataccattactaaaaacagcttatttctaagctgccttacattttcaaaagcatttgaaagtatttttggacttgctaaacattattagttagaagtaaaaagaaacttgtttggttattagggaactcatcgttgcctagaggaagggttagaaatgcctaatccctttgggaataaatagatatatctagtgttataaaatcatgagcacaagataaattcagattagctaattagcctttgcctcatcatttgctattttataaatagggcaaaaccacacttatattaatagttacttccatgttacaagtaggttaatgggctcagtgattaagtaatttatcttcccctttacctgtaaatgtttgttcccaattttagatacagatctctgtaatagtttaagatggattcaaatgttatttctctgatgtacattttcccccaattacctgtctttgctaatatgtatttaaagtatacatttcatctgaattgaagtctccccagatttttcagtattagttctgggtatgtgatttagctaagaaggagaccttttaatatgatgtcatgtcatttgtgtcacgagagtacactttaagattacgagaagattttttaccatagttctctattccaagttgctgttgattacgaagtacgatattgggtcaacagcttttcaggaaatgaaaaaagggacactgtcgtgttaaatgtacaaatagtaagataatttaccttttcagaaaagatgaaaatgtggatgttagagaaataaggaaaaattataataattttgttttttatttaggaaatgatcatcttttaaaaatacacagaagtgttttccaagatgattttgttcattggaacaaaagtgctttagaatgaccgttggtattttataaaaagtctgaagtatatatcagtcagcaaatttgtgaaatgctagattaaactaaagaccttatgtgcattattaatctacaaatattccaaatcttaatttcatacagaccccctttttccccaagaaagatacattgatttaggaaatcctgatagatggtaatattttgataatgtgttaagccactgggattttcttgttccaggagtcttgaaaataattttgagatataaaggcctaaaattgtactgttttagggaatttaagactatgacattggatttaaagaaacagtatattcatttaaaaataaacaccattttttccccttccttgtagttcttgtgaatttaaaagtggcttgtttctggaaatctcttgcgtgagcactgagctagagtcagaagatctgatttccaggtttttcttggctaagtgactttaatcaaaccatgtcacctcactcagcctccctttaggcattttcctaatgcacatcaaaattacagggtcaacatacctcacagagttgttgtaaagataaaataagaaagtagtctatctctaggcatttgaaacttgtaaagtgtttagtgcaagattaaggaaataattgcaccttaagcaaatagaagatgtggatgccttaaaaccttgtttagactaatggctctttatttgaggatggtagaatttttttagtcctaaacaggatttagggacaattgtgccactctctccttttgtcactgaggaaactgaggactagaaatgttaagtgattggccttgggtctcacagagatccaggaagatggccaggtcttctgacgcatgttctgatgccatggccagtctctagaccagtctagaagagaacaatgagctgtctgttaagtaagacattcttcaatatcttcttcccagatattgcaactttttataatggaatgttggtattgttattttaaagatcctgatgatgttcttgtgcagtacactgttacgacttttatactgtgttttgggtaaaaaattaataagttgctttttagcagtgataatttttttcttttttgcatcatattttaaaaaagaaattctgacaaattactatgtaatgtgctaaaactgaaattatgagagaaaagaaaatacaagttagtttataattctgttactgcttcattgtcatctgtgcgatactgacatttagagcacatagcacttgttaccactttcccccaccctattccttttaaaatattttcaagagaaaatgaaaagggcaggtatgtttctttgtgacctcttttgaaaacattttttttctttgcctcaaatattactgggataaaaaaataggattgcttatttttcttggacacacttaaaaaaaaactaggaaataaatgtattatcagtcaacagacaattgctgagaatctactaccgagacattgtgctaggtgctaatgattttaagacatactacggtcttttgcctaagagaccataaacatagttatttactgtgttgttcttttacaatgtgatatcagacattttcttttatttaaaaataccatgtagaataattttctctatttgtgttctttttggcattgtatgaaatttgaatagagaaatgctacaaatagaaaggtgtgaataattttagagccctgaggatgatattatgaaaggttaaattgtctatgctttaataaaaggagcagttaaaaattattttagtcactggaatagtgagtgtgtttgtttgaattgtagcacacctagacagaaataaatcttgttaaaacaacagcttactactgaccttacttgctttgcccattttaggccctagaatcttgactatagtaaaatagaagaggtctactatgtacatttgtaagtgtatctttaaaagatattttaacctgatactttatgaagaaaaaataaaaagaattcattacgcatgccttgaatttatggtctgaaatcagaacccaaacattttattatatactatagttaactaaagtgtgtttagatactacaaactacaaataactttttgtgggattttgattcaatcttcacttccttctcatagaggaactcaaactctcggtcactctatgagattttttttttttttttttttttgggaagacagagtcttgctctgtcacccaggctggagtgcagtggtgtgatcttggctcactgcaacctctgcctcctagattcaagcaattcttgtgcttcagcctcccaagaagctgggattacaggcaccccccgcaccatacctagctaatttttgtatttttaggagagacggagtttcaccatcttggccccttgctggtcttgctggtctcgaactcccggcctcaagcagtcctccctccttggcctcccaaagtgctgggttacaggtatgagccactgcgcctggcctgtgttttgatttgatctgaattgttggttatgtccataaaaagctagctattttttgtttggtttcgtttttttgtttgtttgtttgtttgttttcgagacagggtcttgctctgtctccatgctggagtgcaatggcgtgatcactgctcactgcatcctcaatctcctgggctcaaacgatcctcctgcctcagcctcctgagtagctggtaccacagatgtgcaccaccacactcagctaatttcttgtttatttctggtagagatggtgtctcactatgttgcccatgctggtctggaactcctaggttcaagcaatcctcccatgtcgacctcccaaagtgttgggattacaggtgcttgctactgcgcttggccaaggctagcaatttttgtggggaaaaaaaaaatttaagtactgtatatagaaagataccactatgatacataatgttttcttgtaagttccttgaaggtaggactttttttgtttttttaaaccattatattcccagagcctttatatatccctgtttatatatcccttgtatataaatctttgttgggtaaatgaattaattaatttttatttatccttaagcatcgtaatccttttttgtgtttgttgccattctggtttccagcttgtctgcccgagatgtttctttttttttttttaagtccttattactatttatgaaaggcgattcatttttgttctggtgatctatctattgtttaaaacaataatttattattaatatagctcataattctgtgggttaggaatttggacagggcacaatagggatggtttgtctcttctgtatctggagtcttagttgggaagaccaggaactgtcaggggctataatagatggggcctggctgggcatttaattctcttttttcatatggcttttccacatggccagcttgggcttcttcatagtatggcagcctcaaggcagtcatacatacgtagcagctcagaatgctaagatcgagggtttcaggagtcccaggctgaagcatcaaggctcagaagtcccaaaatactgctgctgctatattctcttggtcaagccagtcattaaggcaaccccagcttcaggggaagggcggttacacttcagttctcaatgagagtagcagcaaagagtttattgctgtctttaatctttcacagtttctgttcagagtttttgttgtcttgtcattattattaacactattaggctgtggtttattctaggatgtctagcaaaataactatttccaagtgtttagatatcaaatggtaatagctcctcttttctctccatgctgtagtttgtggcctgactgcctagagtgctctttgtcctagatgggctagaaagaggggtgttagattccttttgatagaaataagaacttcccaattgggagttcatgctacaaatgaatttcccccatggaatagaaattcccagaggagaatacctgtaactatgtatctatatctatttgtatgtgtttgtatatacatgttttatatatatatatatttatacacacacacacatatatgtgtatgtataaatacactcacagatacacacacacacacctcatttcatagtagataacttgtaggccagtagtacccagattatgatttcatgtttctatttaaaaatttttcccaaatctgcaaactggcataggagtgccacaatttcaattttgtcaagtcattatatgaaaatgaaaatgaccacttactagcatcaccatttcagaaaataaaaggaaaatttagccccatgaaacagtaagctcataatctataataaagtcagattcttcacatttactgaaatttagctttataaaaaaggattacattttttcttttagttttaaaagactttgttctttagttacagttcagagacatattttgggtaccactggtaggacctttgatttgtcagtgaaatttttggtaaacaaaacatgtacatgaatgattcttaaaatctacattttatggccatatttattatgtaaataattgggaatgttaacttggttaatggctcctatgaaaagcagccagtttagtatgttactagattccttttcaatacagaagattttagtttaattaagacctataaaacaaaaatagatttactaactaaatataaacaaaactaccaaatcgataagatttaaattagcactaccatgcaagcgtatttggctgtaacaaaattgctgtgtataatctgctgagctcaggttacattgagttcagcatgtactgctagtagctgtgtgaagatgtttcaaatactccacatgaattttctttactgaattcatagaaaactttccctctcaagatttgacttcaaagaaattaaaatactcatctttaacacgaatgtaagcacaaatggaagtcctgaaattaaatggcaataagttatcagttatataatggtcgtccacatgatttagcatatccatatgttaagtaatttcagattttcatcaaaatgaaagcatgaaattagaaaatttcatggatgttttatggacatttatatacattcttggtctctgggacccccagtttgaagaaaaatttagccacaatagattgttttcctagctgtctcccaccttaggtttcagaattgtcttcttttctaatgaaattccttgtgtcaagtaaagttctcattttgtcacagccttaaatttttttttcttcactgtcttttatcctgcaatattgtattatttcttctatttttttttttttttttttttgcttatgtaggtacaacagccaataactgaataatcttgttagtgaaacctttttgggtaactcattgttaagttggtgcttgtgactgctgtgtaaggctggcttttagaaagtatcttcttgatatcaaatccttttctttgagggaataaggagttgggtagagcaagaattgcagagaagggagcctggcagaagaagcagtaatagaagcaacctgggagagtggaggccttgaattcagaacgacctggattcagttggtatttcttcctcttgctttaacttgagtaaattgcttaacttctcttagtttcctcatctgtaaaatggatttttaagagacatggtcttgctctgtcacccaggctggagtgtgatggcacaaacatagctcactgcagcttcaacctcccaggctcaagcaatcctccagcctcagcccctcaagtagctgggactgcaggcacgcgccaccacacctggctaatttttgtattttttgtagagacgacgtttcgccttgttgcccaggctcatcttgagctcctgagttcaataatcctcccacctcagcctcccgaagtgctgggattacagacataagccactgagcccgaccagcatgtaaaatttatagcaggggaactggcatctgtttcataacaaaaggtagctcctgttattctgtatgcttagggtgttggaatgctcatctcaagatctatccagttttatttatgttttgtatgttagatattttatcaataaattctagcttcacaactaagttagaaggccctttcacaccttttcatgtacatagtgcccttctgtgacgtggaggttgaatagcaattggttaagataggatagtgaggcccaagttttaatgatatatttgttcctgggttcatagaaactctgttagtcatgaggactgggagaagtcctgtcatcagtagaggtactaatctctttgagccccagatttccatctgtgaaactcagtagttgaaacgtgatttctaagtttgctctagatctcaattttttcccgaaatggtactgttgccataggatccagttttctccagtattcctcaatgtttttgttagaacctaggcacctagtaaaatgaaaaatcccatttttagttttttaggaggacaaaaaactctatatagtctcacacagtagggccacatttctaatgaaatctgttttctgataacatttcttctgagtgacatttggatccatgggatgactcagtaaaatacagaaagttgattaaaatgtggctaggtactaactactccacaggtaaagttcttcactgtcctacacagtgagttgcaaagcttttctcttagtctggtgctagcttttggaatactacattctttctacaactctgtaaaatattgacatacttaatcgcataatacataattataatttgagtcaaagaaaataaacttatttttgtttgattaaaacattatggctatgaatacctattatacacacttgtgagctgttttcaattttttttctgtttaaaatactgttcatttggtgcttgctatcctttgttttggtgggtcggtgctgcctagcaggcaggcagagcagtaaaaatacaggtcctgtgctcgggcagtcctgggtttgacatccgggtccgttttaagttttttgactttagataaattgtgttaccttactgtcttcctttttaaggagacacctcctctcttgccctcgtacatgctttgtgtgcattttaaaaaattaatgttctctttattgtattgaaataatgattatatcttaatgcggtcatgttgtgttgatagatttgacctctctgtaggagatgagaattgacagtgaccatcatttggggaagggtgcctttggtggcaagtttgtgctggttcctctgaggctgtctttgagggtactttaggtgttggaagttaaagactgccgctgccctttgtagttacatatataatgttaatgttggctggggtggtgggtcacgcctgtaaaaccagcactttgggaggcctaggtgggaagatcacttgaggccaggagttccaagtccagcctgagcgacatagcaaaaccccatctctacaaaaaaaaaaaaaaaaagaatgaataaataaatatgaaaatcagccaggtgtggtggtgcatgcctaatatagtcctagctactcaggaggccgacatgggtagatcaactgagcccaggaggtcgaggctgcagtgagctgtggttgcaccacagcactccagcctgagcaatagagcaagaccctgtctcaaaaaaaaaaaaaaaaaagctagttacttctggtccactttcttttcttacccatagtcttaagatattatgcatatagttgccaggcatggtggctcacacctgtaatcccagcaccttgggaggccaagatgggtggatcatgagctcaggagttcaagaccagtctgaccaagatggtgaaaccctgtctctactaaaaaaaaaacaaaaaaacaaaacaaaacaaaaaaacaaaaaaattagccgggcatggtggcgggcacctgtaatcctagccactcaggaggctgaagcagagaattgcttgaacctgggaggcaggtgttgcagtgagccgaggtcatgccactgcactccagcctgggcgacagtgcaagacttgtctaaaaaaaaaaaaaaatatgcatatagtcacgcatcacttagatgcattctgagtattgcctcattaggcaagagtgtacttacacaaacctagatggtctagcctgctacatacctaggctatctggtgtaacccattgtttctaggctacaaacctgtgtagcatgttactatactgaatactgtgggcagttgtaacacaatgggaaatatttgtgtatataaacatgtctaaatataaaaaagtgcagtaaaaatatggtattataatattacaggaccactatgggatatgcagtgtgtcattgacaaatgttgttatgcagtgcatgactgtatattatacagaatcttgaagtgttttataggctcgtctgtattgtacccaagggatataaaaggaatgattctaggctcagttgtgtcagaatggtcgttgcaacagtaattaggggaaaaaagctaaggagaagatgaatttctgaggggagtttataatctaaaaattatccacactattgggagaaaaacaataaaaattctacttatagtgtgttggggcctttttacttgaggtgggggtggattggttgttagggtggcatgctctagtcttggtggggaactatccctgagccttttacctctgtttaagaaagattaatttctgcccaataacttatcttccccctccgccgtaattctgttaaagactgttgtcagttttttggcaaagcaccctaataaaagccctaggacttctgcagttgtttaaaaattactagtccagcagcaggttattgtcttactcaaagatggatgcaacctcatccttgccctcaaacagctcacagtctagaggagaagataaattttagtataagataatgacagcaatcatttgtacatgccgtatccaaattcttatttccttttcacatgtcaacacttcaaccttctctagcctgatttatatctttatctctccattgaaactgtccttataaagggcaccagtaatttctgattgccacatcaagtagaaatcttaatttccagtgtcattgaacaatggggaccaccctctccttcttggaattatctcctctggaattttatagtacttgtctttgctggtcttcctcttgtcttttaggtaatttcttctcattttccttggtcaattccttttctacatagtttttacctgtagaagttcctcaagacttagttccagtctcccatcctcctttctttatattttctgccaaagaaatcttaaccatttctatggattcaagtgctattttcaagtcaagggctgccaatttagtatctttcatccttttccaaatttgaactttgtacattcaactacagatatgagattaattggttgtctaggtctatctctgggcaagaatactagtctttacagagttgctgttttattatagttgctttattgtattgcctctgaccatggtaggcaagagacaagatggaaaggaatgggcataatgagatccgtgagtgtgatggatatattatttttcactgtgtcatatatgtaaatagtggatgtgtatgtaactgtagcttaagaatttttaaactgatatattttttctatatatctgttataattatggcctatgaattttttttacatttagtgaggatgaaaatttattaaattgtatatctaaatctctacttgtttaacttatgactaattgtactttcagaagctttttattaaactgagttgaaataacaaaagaacatcttaagattgactttcagttaactttaagcactggttttattaacctaaaaatttatctgtattaatttgtataccttaataggcaaaatgagtagttggaaagaataagtaggaggttagttaatgtttacctgtaagttatcagggctaaatgttattttaagggagttttgccatgattctgttgaccttacagaggactttggagaatgaaaattacctttaaacattttcattagttaagagttattgtctgcagtggaggtatagccttttaaacagagaaagaaatcatgagcttgtctgcagtatatatagaagttaatcagtcaatttataaattattcttctgaggtctagatgcttattagcaccatcaaacttattgggaaacaattttactttgcatgtctagtcctcattctttatattattaagtcttctgcagtgaaactttggaattttactattttattaaaattcacatgaaggctatatattaggacacatttgcattacaaatatatgtaatatatttgtataataacaatatcatgttcaataatctgaaatagttttcaaaggtaagtcgtgaaagtatgactttcttcttggggttatatcctgtggtgacttaaaggtgttttttgtgtttgagagtttgtgcttttaagcaaaaaaaagggaaaaataaattttgtattaatcatatattatgagtgtacactatgggtataaattcacatgtgcttggctggaactattgaaaaatcttaagtaatttgagcagttcttccttagctttttcttctgttccctgtgcgttctcttttttcctgccagtctgtctggctggcttgattaaggtggtgctggctggcctgaaacatgaagtgtgatagttgttgggctgcccttttgtttagtcatctctttccaacagcctgtttgttccatgttttcagttgtccatgaaaaaattgacttggttgttttgagttgacaaacatatctttctttttttttttttttttttttttttgagaaagggtctcactctgtcacctaggctggaatgcagtggcgtgatcacgactcactgcagccttgacatccgtaggctcaagtgatcctcccatcccagcctcatgagtatctgagactacagacatgcgccaccatgcctagctaatttttttgtattttttggagacggggttttaccttgttgccccaagctggtttcgaactcctgggctcaagtgatatgcctgctcaagcctcccaaagtgttgggagtacaggcgggagccaccatgccctgcaacagacatatctttatttacatccagctctattagtgattgcatcctttgattggtagcagctttgagaaaattgtgaggcctacatttgggctgagaaaataataatgccaagatttaataatagtgtctgccaaaggtgcaagatatagggaataccttttgctggtcttgttagtactataccaaaaacctcaagaaggcagttttcaggttggtcacatttctgccatttgctttttcaaatcaagttggcaaaaatagcattatcaaaacagtgaccttctgtaacagcctactgggtaagatcatgtatgaactccagagtcagactcttgtgggttagaacccagacttttgctagttcatcagctctctggctttagagagagctcttcactccccagttaggtttctgtatctataaggtggacatgatagtagcagggcctaccctcataggattgttatgaaggttaaattaggtaacacacaaaaagttctctactcagtgctctcacagaataagcattcaataaatgctattgatgctattgttacattgttgttaagccaaaaaaagtatggcacatctcttattatagtagttataaattaaaatgttcttttagccagtattacagctgtcatttcattttcttcccagtttccattgcttcctctgggtctgtttctatccattcacttaaaaaataaataaaatgaaatattgagcatatcttcttcagttctctctcacgccctgccattaacctacacagttctaatgctgccagctgtcttatttatgtgtggtgtagattcagtcctgactgctttttgcctcagactcgtgaggtgttactccacctgctagttgatgctctacttggcaggtgttcacaccaccatatgcagctagaactacctttacccttagatccctactcacgcggaaactgtagctatcacacaagaaagagcaaggacacacaggtgcatttgtgaaaaatcactaaaatattttttaacattaaaatttttttttgcattttaaaaatttaagtataatttgcagaccataaaatgcacccattttaagtagcaggagtttcagtacatttttgcagtcatatatcttgtgtctgttattcatcttctttaggacacaattcagttttagaacaattctatcaccccacaaagttatcttgtgtccatttttagtcagtttccatttccatatcctgacactggaaaccatcagcctgttttctgtctttatagttttactttttctagaaatttcaaataaatggaatcatacaatacagtgtgtgttgtatttgtgtcagtcttctttcatttagcataatgtttttgaggttcatctgtgttgttcacatattgataattcattcccctttattgagtggtattccactgtatggatgtacagcatttaagaaaatcccttgataaacatttgtattgtttacaatttttggctattgtggacaataactgctgtgaacatttccattcagctctttgtatggatatctcttccccaagagaaatgaaaacatcagggataaaattgcattgtgtagtgagaaacttccaaactgttttcccaaatgactgtactattgcattttctaccagcagtggattaaaaggggttctgatttcttcatatccttgtcaacacttcagataattttactggttgtgtagaatatttcattgtggtttcaatttccattttcctaataactaatgatgttgagtattttttcatgtacttttccttattgtatatctcatggtgagttgcagaatatgttgcccatttaaaaataattgaattatttgtcctattattaagttgtaagagatctttatatattctagatacatgccctttatcaaataatttagctccttatataatatattctagatatgtgtcctttatcagataattattttgcagatatccccaaaattatccctactccttcccttgaaacacattcttagaggggctttgtgaaaactctcgggacagagcagtaacgagatgcttctttattatagagcttttattacctccacttttgctttaaatgactactagtttctcttagtaacttataaaaaagtttgtaattctgtttttatggaagtattttattctttttgtttaaaatgttacaccaaggtatctagatgtttggaaattttagtatctttatatctcctaaacatctttctggttttttttgtttgtttgtttgtttgttttttgagttggagtctccctctgtcgcccaggctggagtatagtggcgcgatctcggctcactgcaagctctgcctcctgggttcacgccattctcctgcctcagcctccgagtagctggaactacaggcgcctgccaccacggccggctaattttttagtattttagtagagacggggtttcaccgtgttagccgggatggtcttgatctcctgacttcatgatccacccgcctcagcctcccagagtgctgggattacaggtgtgaaccaccgcgcccggctaacatctttctttagcatgggtgcattgacacttttgcctcatgttatggtagcttattaataaaagcttactgaatagtatagagccaacagtaatcatttaatataattcctactaatatcacaagtttcagctcctgattgttgcataatatgatgtccttgagcaaattagttgttggtatagaattataacgggcttaagtaggccagcataatgaatacatttatcccagtagtgttagaaagagttgatgactcctattacttaagtttattgcacactattcactgactgccacttgagtggaatccattcattttatttactgtgataacttcttatttgcatatagattctttttgtttgtttttcatgaagtatctctgactaatacactagctgcatttcattatatatgatgagttcaagactggccaggtcttggtaaaaatcaaaatgccatctttttctgtttctctcccctgtagaccttttagattatgaaatcagatgtttctagtgtccaagaaaaatagtaattttgatattaaattgatgttaacttgtttgtgctattggattctatttactgttttaacgagtaaagggctcttaaaggaattagtaatgttttaagttttgataatccaaattgtaaattcttactgatggatgtcatttgaaggaagaaaaatctagtagcttagttataaaaacattccttggagctgattaaatctagtagtgtttaatgttttttaaaaattattcttaaaaagagatacattttcagtatcgttactagtagcaatcaagccacttttcttgagtccataaaatatacaaaagcagtaaatattaatatacataaaatgccgtaagcacatacttcttgttttcatattcctcattgtgtttcttgggaacaaacttaattggtgcagtggaaggatcagacgaaaagctgcaggctcatttacagcgaagcactttgttcacaaagacacagactctgaagaaacattgcaaacagttgccctcattattgaaaatattcagttcttccttttcttattcaccttttctcttgcaaattatcttggttattataacatcatttttactgccataaaggctgtccttggctgggcatggtggttcacacctgtaatcctggcattttggaaggccaaggcaggaaggtcacttgaggctaggagttcgagaccagcccaggcaacttagcaagaccctaccactacaaaaaataaaagattagctgggtgtggtggcgcatgcctgtagtcctggctacttgggaggctggggcgggaggatcacctgagcctacgagtttgaggttgcagtgagctgtgatagtgccactgcattccagcctgggtagcagaacgaaattttgtctctgaaggggggaaaataaaagataattcttgagataagaaattatttagtcattcaggccttttggttccatataggtaaactgtaaatcatggtaaattaagattagcatgggaactttctttatttattcagcacacattttctgcctgttacaatgtgctgggcacagccctaggaatgcagtgtgggagtaggtcactagggcctcctgcttttactcagctttttgtctcatagggaaggctggtggttagacaagcagttaaagtataaggacggccactcagaatttgtaggcacttcataattcacaatgaaatgcagccttatatattttacattaccttgtacaaataaaagtaatgcagcaagtctacttcttgatttaccatgcgatttaataagagatgttattaatgcatattacttgtgtattgatggcaattaacaagtattactttgaaaatcggttataaaaatcacatctgctctaaggaatcttaggattctgcagattttattcacgtttatttgtttgtttatattacagatttctcttggatttggctacacacttatagatcttctgcactgtttacaggcacaggtgagttaacgttgaattcttcatattggatactttgatatttaattaaaattttaaaattctttatatagtttaggaaaatatgtaaataagatgattttaaataaaaacaataaactgtatatttgtctatatttcatttttattatgaaagttccttacaaatgtattggaaataacatttaaaggtaaaatgctcatatctgtttatcagtggttactatatctatttgggatgagtttacattatacccattggatgagttgattacagtttattctaatttcatagcctgacaaaatgtttattatatttatttttatatgtaaaaatttgagtggtggtatttctcatttcttagcaaactagcataaaagaggagaaaagaaaagttactacagattttagcagcaaatctcagacttacaggggtagatgttataaaatgcaatgagccaacctttcttgtccaacctgtgtaaaatagcttctcaagcactccgtatcacacagctgaaattgatttttatcacaatatttatgatcatgtgatatatttttacttactctttacaactttccctgctagcttcatgaacatcgggaccatttctatcttgttcaaaacagcatccctaacacttaggatggtgcctggtatacagtaaagactaaataaacgtttgttaaagtaattatcgggtaataaacattaagaatatatttatattcagagacactgaactttgtaaatacaaatagaaatagtttattaagcttatttcattttttgtttttgagatggaatctcgctctttcacccagtctggagtgcagtggtgcaatcttggctcactgcaacctccgcctcatgggttcaagcgattctcctgcctcagcctcatgagtagctgggattacaggtgtccaccagcatgcaccactaattttttttgtatttttaatagagacggggtttcaccatattggccaggctggtcttgagctcctgacctcaagtgatctgcctgcctcggcctcccaaagtgcttggattacagacgtgagccactgcgcccagactcttaagcttatttctagatatgaaattaatttataccgtgaacttaaggtatatagctcttaaatgttatgaaaaattagttgtattagatattttgtgtatccaaatatgcttaatcagggtagaattaagaagataactcttccaattccacatttattttgtcactgtcccagaaggttcttacaatcaagtaaagaacaaacctgaaggaagtgtggcagcttctcgtctccatactggatcatattaacatattagatgtgttttgtggtatatttatagagagcaaagtagatttgaaagttgtccagtttatatcgctgcaaaccaaataaattaatattttcccactacctgccacttgatacaaaatgtaacttatttcgttttttgtttctaggttggggaaatgttttggtcattttcctgccctatatattgatgtgtttgaactcattatcaaaggtagcggtaggcataattttataagctgactacttatttcctttccttgtgtccatgacagttttctttgtgcttcaggatgtcagttgttattgggttcttgtctcgttttatttttttgttctttcttacctttttcagacatttgcttctctttctgccatcaggatttttcatttatagaaggaattaagtctgacctttaagaattattgaaagtaaaattttagggattatacagctgtttctgattcacatctattttacaagtgcaatttgcagagattctactgataatactaataacaactattacttattgctcttttactgtatgctaggcattatgtaagtgccttttggttgtcttcaaaataacagataaggaagttgaagctcagagaggttaaatgacttttccaaggtcatatcaagtaagaggcagtttgccactccaaagaccttgaccttaaccactgagctccattttctgcctaaatacccctagtacaagaatatttgtgacaacaattgtagtacatgaaaatcatattcatatttgaagacttcaaaattaatttaaaagccaaacattatttcacttatatttcattaggagaccttaacttgtaattgttattccaaactgaaacatgacgactcatttgaaatgtaatgattacctaaactatttaagttctactctgagactttgattttatactcacagattatgggtaggggcatgggggacagctattctaattcctttttctgttgtaaacatgatatgctattaatatgaatcagcattctttctctcatgcaatattagaaattttagattgtaagtggcatctgtggttcattggataaatcacttttcttgcaaagaacagattgtttgaaatatagtgactatagaattacttagaacctttatcttgaaaaatttgatagtttgtatctctgggaaaaatactttaactattgaagaaatgaagtttagtatatagccttgcagtatatcaggagttggttcagatagaactttagcttctcttacttagtttattttcaaagctgagtaggacatactatgtaaaaatataattattatattttgggtcttaaatttataaagtggacaaaatgttctgaaggacaactttgttgaatataccttaagattttgatttgaaaatattattatttatatacttccttagactttccaaaagagttgtatctatgagtgtaaatgcaaattccagatttgagtatatgaaaaatggaattctgtagtttgagttaaaaagacaaaacttattgaacagactgaactatgatttttaatgtacagctaggtcagtatttccgttctagtctcacattttaagcatttttaaagttagccaataaaatttacttggcattgataatcaaaacaggagcaagagttatataaatctatttggcaatatagctttgaaatgtaattttcctttcactacagaaagttgaactcactgtggatttatatagaccttggatttatttataagttttctctgtgttggaagatttgggtgggaggatagggtgaaggtaggttggtgaattgttcacacatgctaagtacagcccaactcttaaataccaacatgggggagaagttctccactgtacaataaaacacaatatatacttcatgtagtaccagtttactttgttgttgtgtactaagtgctatatactaaaaattaagcatatcaaggcctaagagaaactttgaccatattggatatgacatggttgaaatacatttcaaatgaatatttgttggagtttttaatccctcctttgttcatagatgtgagaagatttgtgattagatatctgatttaactggatgtatatgtatccatgaagatatgggcactttgatttgaggtacaggtatcaggctttgggcactatctactgaaaatcagtattaatctaaactaaaattgagaatactgaaatatatatcttttgctttaggcaaaatctgcccatatttatttatatcactatttttgtggtattttcttcaaatgacagcatggtaggcactgtcatctgtagaattaaaaaaaaaatttaagttgacaaaatgccctcagtcatttaactgttcagagtagaatcacgatcctggtctcacagggtagactcctctgcacttaatacgcagaacggactactgaactcaggatgatgtaggctcacattgaaatgatcttctgatgggtgttgttgacacaaagccagcagttggaaactgacaggcagtttactcttttcttgttgttttcttccttttatgtgcacacattagtgtgaaccggttagcttagttttcctcattaaactaaatcattcagcaccattaactctcctttctctcttcctgacttccttttacccttaggccatccctagcctaggctaagtgctataggaaatacaaagaatggttgccaaaaattattaaattaaaaaggattatctatccatgcaagtttaactccatgtttccttgttcgatatttttacattgtgtttaggttttctgattctttttttttttttttttcctgagatggagtctttgttgcccaggctggagtgcagtggcaagatcacagctcactgcagcctctgcctcctggatttaagcgattctcctgcctcagggctgggtgcggtggctcacacctgtaatcccagctctttgggattcccaggcggcagatcacgaggtcaagagatcgagaccatcctggccaacatggtgaaaccccatctctactaaaaatacaaaaattagctgggcatggtggcgtgtgcctgtagtcccagctacttgggaggctgaggtgggagaatcgcttgaacccaggaggtggaggttgcagtgagccgagatcacgccaccgcactgcaacctggccactgcacgccagcctggcgacagagcaggacttcctctcaaaaacaaacaaacaaaaaacagggcactgatttctgaattatatgtctccctattcaaagtctttttttttttttttgagacggcgtctcgctctgttgcccaggctggagtgcagtgggtggatctcagctcactgcaagctccgcctcccaggttcatgccattctcctgcctcagcccccgagtagctgggactacaggcgcccgccaccgcacccggctacggggtttcaccgtgttagccaggatggtctcaatctactgaccttgtgatccgcccgcctcggcctcccaaagtgctgggattacaggcgtgagccactgcgcccgcccggccaacttattcaaagtcttaatctgtccatgtgaatcgaggttaaagcagtagcaacaacaacaaaatgctatcattagtaaatgttttgtttattacttagtgttaacagagctctcagagtgtgctcttaggaagacacgcacctcttaaggtaggtgtgtcttgcttagtgaggttgaacaaatcacagtccaggcaatcttcattctgcatgatggcattgctgtcttcatatggacagacaagtagaatgatgttggaaatcatgtatttagaattagacagtaatttaatttttttttcagaatgcacaaggatgttgtttcttggagtataagagaattgaattttagcttagagccactttactgtgggagcaactttttttaaattgaaaatttctaagtgtgacctctgttggcatagctggtattctttgaaagtaattaaaatgaaaagtattaccagtccatatcttgtgtaaatcttttgagttagcatgtttagaggaggtaggactggtgtcagaatattctgagaaagttagggtgggccataatttctcagctatgctttctgtactagaaaacaggagagatttatgcataggagtgggataagtggtttaatagattgttaataaaatacatatctgtttgttgtttttgttgttggtccttagggttcaattcaaacttgaatattccacttgtctgggtggtacagttgttagcttcagggagaaggtctgtgacaagtagaatttcacataaatgccaccacagtaacttttgaaatacttggcattagatttgggtcagttagtaggatttttagctaggctgttcactttcactttggaaggcaaatgccagatgtatgttattttctaggcaggtgctgaatttgagtcagctaactttgccagaatccccttaaagataaaatagcaagtaaagtcaggctgtttccatcaaacaccttatagttttgttttttttttaagctgaaattcatacatgttattttgaaccatttataacatctagatacaagggtctaaattaagcatttataaaattatccatagccatgcaattaagttttttttattttactgtgattctttagcattaggatataggtatttctatttattttgacttgtattgctagcttgagactcagtataatgggagaaaaccagagaaattaacagtaagctttgcaaattatgatttttatcttaattccatgcattaggttgtctaagccttgtttgctatttcatgaatgattcatggatgtctataatcaatggaaataggccgggcgcgttggctcacacctgtaatcccagcactttgagaggccgaggcaggcggatcacgaggttaggagatcgagaccatcctggctaacatggtgaaaccccgtgtctactaaaaatacaaaaaattagccgggtgtggtggcaggcgcctgtagtcccagctatttgggaggctgaggcaggagaatggtgtgaacccaggaggcggagctggtagtgagccgagaaatcgcgccactgcactctagcctgggcaacagagcgagactccatctcaaaaaaaaaaaaaaaaaaaatcaatggaaatgtattttttggcctaggcaccattatattttgccttctcatctacaaagattaaagagaaagtaagaagtatacgtaggggtagcatttagctgaggcctaggcaccattatattttgccttctcatctacaaagattaaagagaaagtaagaagtatacgtaggggtagcatttagctgagcacagtggcgtgttctgtagtcccagctactcaggagccttgaggcaggaggattgcttgagcccaagagttggaggctgtagtgtgtcctgattacctgtgaatagccactgcaccccagcttgggcgacatagcaagatccagtctcttaaagaaaaaaaaaagtgtgtagcacttaataatggccaagtagggagtcaacatacagtttaaatcaatgtagtccaattttgaggaggatcttttaactgcatgcttccatgcaaggttgcttttgtggtgccactgtgtatggaattgtttgttttcactactttttaaaaagtagaattaaggacttcctttttttaaaccaacagttttggcttttttggtgccagttacataaattttacaagcagaagtcacacattagtgtcaacctaatggtctggaaatttgttaactatcagtatgacagaaccccagcatggttttatcatgtttccctgagaagtgaaaagaactgggaaagcaaggatgtgataggccagagtttcagtggaaggatgaatggggaaatttttaagatacctaccagtgttggatatgagtactgagacttttaaatctttacctagactataaaagactatctttaaaagaaacagctgtgtcataattattgaattggtagcttattctagaatatagagagtagtggccagtgaaaacagttcatctctcaacttttcaattctttgtcattaaaaaggctatttgatctagattactaattcttccttttaagtggcggttttattacagtccagaaaacacttctgtttcctgggttataagacagagtatgaaaatagaagatagttttgaactcatgtattttgaaactgtatcatgattacttacgctattatatttgaatagaatagaaatataaaattctttgacttaaacatctattggacaaattggtttgatgagtttcttattaatataaaacagtagattttattttattaactgagtagaatttagatttttttgtaactagatgctttgggaacagttaaattttttctctaatatagaggttagatgtttaattgttgctgctgcttcaaaatattcacaaaatttcataaaatctttattgtctgacacataaactatttgcacttgtgcgctgacatattgcgtatcaaagtcaggttcaaatttcctctttaaagtatcttttggaaataggaaatgatagccttttgtaaaatattgctgttatcttttaaatgtatttttaacatatcctaaatgcagaagcatgttcctttaaaccgtaatgtgtgtgccctgtgtttatctatttccaatattgtaatttatttcttccttttttttttttgtttttgttttgagacagggtttcgctctgttgcccaggctagagtgcagtggcgcaatctccgctcactgcaacctctgccttctgggttcaagcgattctcctgcctcagcttccccgagtagctgtgactaaaggtgcgcaccaccatgctggctaattttttttgtatttttagtagagatggggtttcgccatttggccaggctggtcttgaactcctaacctcaggggatctgcccaccttggcctcccaaagtgctgagattacaggcatgagccacacaccggcctatttcctccatatttttaaaaggaaaaaaaataacccttcctctttcacatcatagtgaataaaaaattcttggaactgaaagatcatttataatagctagcatgcctattgtgcttatcatgtgccaagtagtgttctaagcctttctcatagtaattcacataatcctcaaacctatgatgtagctgctattatgatcctattttaaagacgggtagacaaaggcactgagaagttaaataacttgcccagtgatttgcacctaattagccagttagaggccaaattgggaatccagcccaatctggcatttgcagtttttggcttgtgaaacttggttctcttaaaacaaacaaacaaacaagcaaaagacggagaaagccaaaaaagaattaactagtaattttcaaaataaagtttcaggctgactttgtcattataggtaaggctgtgacaaggcttaatgctgtgtatgccattttctctacagtgagggtctgcaggctcatatcattgtggctactagctagactgaagtccatgaagttgataaattgcctattttatcagacatgataatctgccattaattaacaaaggaaatgcaggttacagaaatgatattatgctgtttcgtggcttcaaatgaggttacacagataatgctttcaataggatgtgtgtttagcttttctattaacatggttattttgttttgaaagatggaaaaacagggcccagccctactccctttgattcgtctctttaaaaatgacttcacaagttttattcagtaaaaaaattcttaaaaagtaatttagaattcccataatcagaagcctatataggacctttttacgcaaagttgaagaaagttttcaattctaaagcaaatttcagctttgatttagaaaagagtacattcttttgttccagcagtgaaaagaaaaaaatttaaaaaagagaaaatactacattctaagagtgactagagaatcctttcaattacttttaaaaacctaattaattaattaattaattaatatattttttgagacaggatcttgctctttcacccaggccgaagtgcagtggtgcagtcatagctcactgcagcctcgacctcccgagctagattgatcctcctgcctcagtgtcctgattagctgagattacaggtgtataccaccacatccggctaatttttgtatttttttgtagagacaggatttaagcatgttggccaggctagtctctaactcccgggctcaagtgatccgcccatctctgcctccctaaatgctgggtttacaagcatgagccaccacacctggccaaaaaacccttaatttatattggacagtttttgtttcattttgactatatttcagattatcataccttaacagacatggcctttttattttataaaatgttaagaaaaataggccatcctttctctcagatttccccgggttttgttttgttttaaatatatataggggaaattacagctgctctttacaatcaatacacagggtttttggttgcttatgagtatctgtgatataattaacagtatttaccatgaacacaaaaagaggttttaattgcttactacctagaatttactttattcacaactgccgttttctttttctcttgtcttttaaagcaatttctaagcatacatagtaaagataatttaattaataatgtgaaatatgtttttagtgtttgagcaattcatgctgtttcttaaatcactggttaaatccacctttaaaattttatctttgagtatttatattgtagctcacggttaagtctcttgaaaagtttgtttcatttactttctagcaagggtttgaccacatctttttaaaacagagatggaaatatatatgtatatttccttttcctttttcttgctctgtcaccagactggagtgcagtggcacaatcatagctcactgcaaccttgaactcctgggcagaggtgatcctcctccctcagtcaacatgcccagctaattttttatttttttgtagagacaagtctcgttatgttgcccaggctgatcttgaactcctgggctcaagtgatcctcccacctcagcctcccaaagcactgggattacaggcatgagccactgtacacagcctggaaatattttttatacattagaatataaagaagtgcaaatttaagaaggaaacttttcttgcatacctacattctgctaggcataatatgctttttatttcatcaaattcttaccagtagcttgggagagagaacttaccccatttttagctgaaaacactaaggtatagagagatgaattaaatcatattgtcaggtaggtagttctggaatttgaacctgaaactatatatttccaaaaatctctttctgatatgacatagagcctcctctagtgatacaaatggaacttgttgattacatgaaagccctgatttgtttttcattccccatccaaccggtagcatttttcaatttagtctgtactcatttctggagcaatgatagtgcatgcagtaaagtagtcatgttttaggtatacagaagcaatatatatagtcctacccacatcttacggtgtagtaagagaaatggcaaacattaagttacgtgaatgggattacaaagcagtgtatcaacaaatgtacaataatgtagtaggcatagagtgcaggaagggcagtgggcactgtgcccatggctgtctgtctctcagtgttcttcgccatgtgcgtatcttgctatgaaggctacaacctgccatctattttagatcatcacaacaggagtagttagaaatgaaacacagaaataaggggaatcttgattaatgggactcaagtgccaaaaggtaggaaaatgactcttggttatcatcttagctgaagtatgtgagcacttaatggtggatgctgtgttctaaaccttgtctaactacatagtaaatttatttgctaaatgataggaactcataacacttgggtatctacaggactctaagtaaattcttgttgatttttaattttcttactagaccttaataaattgtatctgatatattttctatttgaagaatacctctagttgaagaagtataaaacatggttaagcatgaggctctcaaaagctatcatgaatataaggatattataagaccatgtcctttttataggtagtcacctgtagctacatcagatggaaagtgtagagcaggtctggttttattgagcatataatgtaaagcctaccttgagggtcctttattcttgataccaacttgagtctaatctgttctccccgtatagattctacttccctgctccgtgggacatctgttctttttctagtatgtggtttttgtgttgagataattctctccccgtctcccctctcccttctcccttctccctctctcctgtctcctctctccatattgtgccttaaaagtcttcacttatgctgccagagggtagaggcaaagcttctttcctaacaatctcatgatacgttgaaatccccttcagtaatacacactctcttccgtacaccacacccacacacacaacacacacacgttctccctcatttgtatataccatcccttaagaatggatgctcattaagttagccacagattatctgaagttacctgataggcagtttgtaacaaagggggatgggagaaggtggctgagagggttaaagtccctccctattatagtcttccctttctagctttttaggaacaaatgagtatcatgagagctaaagaccttcagaaagtgaggataaacaactacaaaatttattttctaggacattgctctcttgaaaatcactgagtatttctactaattttcttttaatacatgttttctttgtgactacttccttgcctccatctacttccaccctgtcaggcctccttttagagggagaataggagtgaaagagaaagaggaggacatttatttttcaaatttgtatccaaggagggcttcacacaaattctcacttgaaagcaccgtccagagattctgaggatgagaatctaaaaagagttataaaagtggtgaagcatgttacctgtggaccccagcagatgatcatttgtgttcttcagcctctctcatcccatttctagtgcaccttgctgttttcaaggggtgttgtcattcttggcagtcatctagtgaggagagggggctgtttctaacatggaggggaatgttgcttatttattcaagaggaatacttctaaacattgttattgctaaatatgttattgtaaacctggagaaaaggggaagaaaaatcattcaattagacaaataaatgtagattgagcatcccatatctgaaatcctccaaaatctcaactttttgagcaccaacatgacactcaaaaggaaatgctcactggaacgtacaggatttcagatttttggatttggaatgccaactagcgagtgcaatgcaaatattccaaaatctgaaaaaaaccagaaatctgaaatacttctggtctcaagcattttgggtaagggacacttatcttgtattattttgacatattatcagaaaatactgtataatggtaggtagacaacataaagacttttaatacctctttactgattgttctaccaattactatagcaaataaaagttaaggctgggctctttgatctttgtgtcttacatcagaaaaaggtgtaagtgaaccaaacatgcataagagtcagtgagtcggtaattcacccacttgttcccaggtggtagctgtgagatcttgtgcaaattgtatttgttgcctggactcaatactgaaagcagtctgaaagattgcttctagaaatctgttgtgactctgcacttaaaaactcatcaatgaccattttaaatgcatcattttggtattacgaatacacatctccactttgagagtgaaggaaaaaaatgatacaatttaactaatgtccctaagaacaactagtcgcacctatcgatggcaaagtttaaattccccattagttttctgatttttgcctagaatatctgttggaagcctctcttcaatttcgtggataaaccaaggaagataccagtgttagcactgaattacagaatgtgttcactagaagataaactagtagatcctgagttaagtcagcatgaaccagagtcctggggccaagctctgtctgtactgaattttattctcagtgtttagccctgcttgtgggtggccttctggatgtttactaaaatgaaaattcagtttttgtgaacagacacactcattcatatgtgtgctcacatgcacacacactgtgagtacattagtattttagaaaatggggacactgagatcactctggagcgtcattgcacatcagatgtgggtcctgtcacttgggtttaatattacaccaaccctagtagtatccagctgactctcttattagcaatattgaacgaatcatggaatttttgacaggaaaattttatgattgggaagaaacaagtccaggagcctggctacttttttttttttttttttgaggcagttttgctctttttgcccaggctggagtacaatggcacgatctcagctcactgcaacctccgccttccgggttcaagcgattctcctgcctcagcctcccgagtagctgggattacaggcgtgcgccacaatgcctggctaatttttttgtatttttggtagagatggggtttcaccatgttgaccaggctggtcttgaactcctgacctccagtaatccacctgtctcggcctcccaaagtgttgggattaaaggcatgagcctccgtgcccggccttatggcctggctgatttcatgtaattaattagtagaaaagacgggacccataataaggttatcctgttgcctgcacagtctttttgttggcagttgtttttgtagtccttgatatatgcatgatcatatatctttattaatctttataatcaatctgtatacatctagttggatataatgaacttggattaacatgaaccccatattgagatgctcaaataaatagcattttaatctcttacattgctgttaaattgaatctcaggaaattagaaatcagcatatatatgtacacactaatttgttggggttagtagacatttggtcttatctctcacctcttaggtttcattattttgtgttggtatcaaatattcagaatgatattcctacagactataagatcttaagttgtagagaaagataaaattatattttgaatgttatattttactaaaataggaaattatatcatacacttttaggaaggctttgaataataaataatgatgaaccacatttggtggtgatagtggggtaacgtaacttatctcatgagtattctgattaatagtggctttgttgtagaatctccattttgcaggtgtaaagatctgaaattctaaagcttagtgtgttttcaaaactggtactgtgagcagctcttgagcattgacccttggccacggactgctgcatggtgttcaggcaggatatgtggaagagaaggctatgtttctcttttcctggaagcctctgattctgttgagtgttgttacttttgctgctactatccaagaaaacaaagaggtggggggtgatgagtttcctagtttagaggcttttctgggaatgctccctagccacttgtacttaattcaccttttcccttgatctacaagaggccacagcataatcttttctgtatcaccagctgcttatgctccctaagtggaagagagatttaagttaatgcaactgcagagtctttcatacctggaatttctaatgtattttttccttttttttttttttttttttttttttgagacagggtctcgctctgtcacccaggctggaatacagtggcactatcttggctcactacaacctccgcctcccatgttcaaggttgattttcctgcctcagcctcccaaatagctgggactacaggtgtgtgccaccatgcccagctaatttttgtatttttagtagagacgggatttcaccatgttggctaggctggtctcgaactcctgacttcaagtgatccacccacctcggcctccctaagtgctgggattacaggcatgagccaccatgcccagcctattttttcctaaattttaataactggttcccagtgcttaattcacattagaagcttccatagccaggatgcagatgtgtacaccacatcttcccagccctctgccttcccctgcagatgcccattatctcgtgtgacatgctctccacagagctcacactggcctcccattcttaagatcgtgtatgagtgggaagccctcaacgatgttatgcaaagtcattcttttggaaaaagagcctggaagtaaggggtagaatggatttctatgaggcataactaactagtaggaaaaagccccaaagctgcttggtgtagatcctatgcttgactccaattttctgattattcttggtcatatcgttctttctactgtactataccagtcactgaggacacagatgatgtctcaatttcagtatcttctcctgtcaccaagaaatctagtttagattaacactcaattttgtaacatttcatgaacactatattcagaaaaactggttctatcctatttactccacccatagggaagtagttggtatattgtgtatgggtcagtatttctatatcttacatgaaatttggaagaattctatacaaccaaacctgacccttcaatttcagcaaattgatttctgagaaaacagatgaattttgatttatcttacgtctctaaggatgaaagcaacagaattgcgatcgcccctcagttggtccaattctgtgctgtcttttatcattttccccattataggttgaaagcttcagatgtcacaatttcccagggtcttaggattctaccctggctctggcagcctaccttcattgttttacccaccaaaggaaatggtagaaactcagctctgaggcaaggggttatggcttctactaaggtatccctaagaatagggcatatgctttgtctgagctttaaactatataaatggtgatgcagaatggcagatgcttgaaaggtaggtatagtctcttaatgcctaaggtagactaacacaagaagatagattcttgatgtgtgtagtcatggactccttggctgcaagtgtagaaatgcaactcaaaccagtataagcaaacctggaacttattaccttttgtaagtgggaagtccaaagctacaactggctcagggcaagtctggatggaaggaattaagtgatgtcatcaggaccttctctttttctctactttcttgtgttggcttttttcaattaggaccttacgtcatggcagagaaggtcattagcagctctgccttatgtcattttaacagtcaacaatcccctctcaaaaggatctttcctgatagctctaaaaaaaaattacaggaatgactctcactggtccatgttggattacctgcctgttcctgagccaatcttgccagggggctgaaattaaggcacagcattttggctagtcctggtcactctagaggctgtgaggaagtagggatattagtctcatcatgaaccatgtgacctgacaggggagggttgcttgcatgtgttgtagaggggtaagccaaggttaaggtttgtgttttgtatttccttaccagctttttatcaaccccagagcctaggaaagtccttcttactcaggaattattcaggtatactaataagcatagcatttcctcatgagagccacaaatagtgttgaaaatccactctatgccattgattgtactagatccgctggtaatgagaaaagacacatttcactcacttggagtgtatgtcattgtggaggtgatggcatattgaaaaaaaggtaggaaataaacagttccatcataaggggaagcacctactgcgggtaattccaggcagagagggcagcatgtacaaaggttcagtggtgagaagagggagcaaggcctttggaataatgaactccagttgttcctcataggtgcagcagaaatagcgagaggtcaggattatggagattggtaaggcgagatcatccaagggccttttgcttggtaagccattttactttaatcttgagtgccatagggattcattgacggattgatacagggaaatgaaatgatttttttttttttttggttgggggagacaagagtcttgctctgttgcccaggctggagtgcagtggcacaacgtcggttcactgcagtgtctgcctcccaggttcaagcaattctcatgcctcagcctaccttgtagctgggattacaggtgcacaccaccacacccagctattttttatatttttggtagagacggggttttgccatttgtccagcctggtctcgaactcctggcctcaagtgatctgcccacctcagcctcccaaaatgctgggatcacaggcatgagccaccgtcccaagccaattcattcattttagaatgaatgccctgtcctggggtgaatggactagaggagggcaatactggaggctgaggcgggtttagcctgtggaagtgatccagatgagatgtgaactgaggggtagtggcagaggggatgaagataagcggattctaggaagtgactgacttctaagggaaggaggagtcaccccaggtcttacaaaagacctggtttggtctcctgtggatatccaggctccctatgatccacatcatcccattaccataaactagttagtagactttctatattgatggaacgtgaatatgagaatgttcatagcagcattagtcataatagtcccaaaataaaaacagtccaaacatccatcagctgatgaatggataagtaaaacttgctatatacttcagtggaatattatttggcaataaaaagaagtgaaatactgatacatgctacaaaatggatgagccctgaaagcattaaatttagtgaaagaagccagtcataaaggccatatattgtatgattccatttatatgaaatgtccagaataggcaatgctgtagagatagaaggtagattaatggttgcctagggctgggattggagagtgggagaaaatgggagtgagtgctaatggatatagggtttctttttatagtgttaataatgttctaaaattgattgtggtattggttgcacaactctgaatatactaaaaactattgtacattttatttaaattgatgaattgtatggcatgtaaattatatatcattaaagctattataaagatatgaatatgggagtaaagtctagaaaacagaaaactggctggtagaatcaggcatatggaatacatcaaaaacgacagtggggaaatagcaaaaaactggaaaaaatttaaatgtctaacagaaggatggataaattgtagtgtattcattttttaaaaaatgacagtgagtaccctgataattaagaaattcacataaaagtatgaatagtgtataaacgtgacctaaaaatagcatttgtgggaacatttagtttagaagtaatttttttttactcaactgtctggcccttaatactgctattaacattaccaaagaacaccatttaggaaggtaaagaaaccatgtactttagcaaagattttattttaaaatgtagggattttatttttaaaaaagtttcaggattagtttcatttaaccgaaagatatagctacatctttagaacatctttacagaagaaccagtaaatattttctcatctgaattgtgagtttcttaaggttagggtaaatagagaaaagaagagattattacttggaaaaacagaaaaggcaagagatagtagtaatgtatagtaaagtttcagaaggaaattggacagttaaggatcactcaagctttagtgacttctgtcatttgtgctttattgcagaaatgttatacagaccatttttgggcatttgtctcattttgtttttgcgtaatcactgaagcaattaggaaaaaaaacaaaaacgcctgctttagatgaagaacccgagggaaaaaaaattaaagagcttgcccatggttgggactggggaatgaaggataaaacacaaggtggagaaatctaggttctgcttaaatggggtcttagaaattgttttttaagagaaagtatttgtgctttagtatacttacactttattatgttattcattctgaaattattttacttagacaatgagacagcagaatgaaagtggctagtaaagaatgaaaatatcagaaaatttagaatgccatgtagatgatgtctgttttttaaaggtctgtatatcagaatttgagagaattgttttgagactaacgggtgtatatattagtcctcacgctgctatgaagaaatacccgagactgggtaatttataaaggaaagaggtttaattgactcacagtttcacatggttaggaaggcctcaggaaacttaacagtcatggcagaaggggaagaaaatatgtcttccttcacaaggcagcaggcgagagaagaatgagaactgagtgaagggagaagccccttataaaaccatcagatctcagtgataacgtactatcacaaaaataggatgggggaaaccacctcccaattcaattacctcccacagggaccctcctagacacctggggattatgggaactacaattcatgatgagatttgggtggggacacaaccaaactatatcagtgtacttaaaatttggcattcagaagtttttgctgccatattttgaatttacttcttaaatcgcctcaatttgctattctttaatgttaatctttttttccccctaagagcaagtttctcatcttggaatctggaggatttatttgtctttcctgagaatttcctttccttatctttttaattgcagtgctgttatgggtcctgtcccaaatttcttccttaatttctttttctcttttcatttaatttaggcatattcattttacattaatgatctgtgcctccttttatcttggaggaagaaattggtattctttgagtgtattgtgaaattcttccattaaaattaacagcaaatattgaaatatgtctctgataattagggaatcattcatagaaagaggaacaattctagatgttttcaaaggtcatctcagtcaatattttaccttacagctaagtggacaaaaactttgcaaagtttagtattttttggccaaactatttctgctatactaccagctacatagcctttatagttgttgaaagtgtttaagcataagaaccatcgtctatctatatatctatgacacaagattttcagtgcacttttaaaaattaacacatattctactgttggttgcatctgttccatcctagttctctagaagaactgccaattagagtctagttctttgtgttggtgttctaattaatcaggaaagcaaaatttgcttttatgtctttgtgaaagcccttgctaattagaaacattaattcaaaatttttttcatattttctccgctaagcttgttcttctttggttagctgtttgtttttttaattagagtaatactacatagacaacctgttttaaggtatcagattcctacatataaaataatttaagtaggagttgatcatttgtattgctaaagattattcagttttaaaaaagaactcagcaggtttccttttaaatattaaatttccttcacatattgaaaataaaattcaaatttacatgatttatatagtatttttaagaatacaattctttaataagctgaacaactatatataagtacttatttctttttaaggactatattctactcttagatgatttctcattatacctactgaatttatggtgatgatttcagtttactggaaatttcctgtggttaattaagaatacagttttgcaagtaaagtttgataactctaaatgagagaaataaaacttgagaattagagaattttagaagatggcatatttgtacttattttgatttttggaatatctgctcatttaaaataatcagaactacagatgaacctactggctgggtaaagatgccttttgattaggtatatatgagttttttatgtgcagaaattttaatatatttaattgtagtgtaaatctgttaggtctggaaatggtataacttactgtgccacttctctagccgaaatcttaattacgggagatgatgcctcagtgtttctgttgtggacactaagaggtgagacagtggagtgagcgagcatcttcagtggtaacagagttcacgagtagcgatgagattgaggtcctgattatgaatacttttcagttcatattttatgggattgttgcgttgcaggccaccagtgattttgtaaaggagtcttagaataattgctgtgttctataagcagtatctttcggagttattttggaagaaaatcattttgctaaatatgagaataaatatttgcttgatcattaaagactgtatttgtaatatgaatgtaaaacagatttgtggatagagctaatgttgagcaaatttatgatgggatattaccaaaattattcagagaatttttcaaggatgacataaagcaaaagaattttgtgattggtaattagtttaaaaaaataactgtaaatttttgaccctacttaaaaagccctggagttgtgtaaagcacttacagatggcaagattgagcacatggtaggttctcgcccttcacagcaattacaattagctgaagctctgtaggctttggaaacttcagtatcctaatggagtagatatggatctgaattatttttcaggtgctcatatgtatcagagaaccaccaagcacttttaaccaaaaaacaagtttttcttgttgctttagttaaatgtgtccctgatgtaaggtttttttttttttttttccaaacatgagaactttataccacctgtgttacactacactgtgatttactgtgtacagatcggtgtcaatgaaataaagaataaaactgtatactaggcaaagaacttcgttaacctttgtttcaaactttattcacagacttcttcggcttaattagctgcaaagaatgaattgcgtataagcaaaaactgaaaagagctgtagtgtccaagggacttgagcttaaaaatattagagatctagattttatcagacccataaacaaaaatttcttaaaaagcagtcataatataaaatagcagctcccagtaacttcttcaagttttgtcttcagaagttgagtcactgaagttgactcacttcagtttgcctcattcttggaagcctcatccaaattctccacaagatctggaacttcatcatcatcattctctccagtagtaagtggtgcttttccacccacagattgtttggacagtgcttcagccagtccttaaactagtcagactgcctgcaccaagctggtttaagattctgggtagcatttctgtcagctgctttgtctcagtatagcctgtaatggtgaaagtgttcactgccagagatgtctgggctttagggttgttaaagtggatcactgttgcttggtttgtaaacatattcacctcttcaatgccagagatttctaacttctttaaggagaactgacgttttttatcatttgctgtggctgttctgtgaaccaccttctttctgtgagcagttccaccaatgggcacttttgcctgcagtttggcgagtttttcctggttcatgattgtttctttcatcttgtcgcagcggataaggggctgcgcgggggactagggttggtgctcagggggtctcgggggaaccagctgagattaggtgcacacacacggggatgcaagatggcagctccctgttctaagttttttggcatcatgttgcaagttaaaaccacttacactgaaatttctgagatgtctgctcactgctttaggctactcttatcatcatttaaaaaattataggtgtgccttggcagcatataaataggtactgattcattgtttcatccattgaaataattttggcagatttatatacacaatcattaaatcaattcacagataagtttttaaaataggaaatatcaaagataaagttattttcttagtaaaatacctaagtagctacatacaatgtataatttggcttgtaattaatgtatttcactgttaatatttctgatagtattagagattactttaaaaatgaagatgaaagttagttttcttcactgtaaatattaaattattactttataagtgtttaataaatctctacatattgaataataaagggattattattttacatctttaaagagaatttttatttaggaaattaacattcagcctaatgttatatctaacatggtgtccttttgtacaattgtatcaaataaagaatagaaactatattatggtttctagtgatgccctaaccactagtgtttcatttttctggtgttccctcttacgtgcacaccccttgctcccctttgggttgacttataatctgacttttgtgacagatgttaggaggtggagcaaaggaatttcagaccaatcagttaagagactgctgtggggtaagaaaaaaaaattagcctcttaaaattactcttatcaaaggaaaaaaagttggaagcacatgatagtataaccagaaacatgacacagaagaattaagggaagagtagaggagacacgtagataagttagatagttactgctgagaaggttttttaggtgggggtaggggtttcatgttgaagcctgtgctttgctttgagtgaatctggcttaatttctgtaaacatccctccttctaggatgaatcaatgcattttagccatgtctatacctgtagcagaatactggtgatgaaagtttacaggcagtttaaaaaaagaagaagaaaaagtgaaaaaccttgatgtttcaaggatcccacagtttctgccaagtttgaacacattccaaaatcctaaaaaagtgtgtacttttgaagctttatttttcaagtgtttgtatgtacatttctgtaagttggaaatcagtcaacaataaatacgtactttaaaatatttcttttactttggtaattacacatgtgtgaagaattcctacaatttttcaatctctttattcaatttactgggatatctgtacagtttttcctatggaaagtaatttcagtggagagatttagctaggaacttcattaggcagcctgtgtgattcaggagcaaaggaatagcctgttagtttaatgtgtagaaggttgtgtttgcaaacatgtgggttgagggcaagtatgtaggcacaagctgtcagaagcaaatgatggatctggtggctctggtttgctaaggcgtttctgtctatctcagtcgtgcaggacctggccatcctgtactgttgctgactgaaggccaaagcttcgcagagcagagtgctgacatgtttctcattgtacatttgatgttgaaagcactaacatgtaagctctggaaagcatttaatcactgtagtttctaaatagtcaagtctagtgagagcaactttcagtaatttacaacttaaaaagttgagtgttttttcccctaaaaatcttactttattaaggcatttaattttaaaggaggaagaacttcttagttttcccattagagattacaaaagagcataatgactgcttattacacagtcttcacataaacatagcagtttaaatttacagtcagggtaccctttatagctacatttagtcagttgaaatatgtaaaaattaatactaataatctcagtgtgttccacagtactctggtgcttaccttgttttttattttttgttaactcaaagacatagcaaatctgtcatttactatactgtatcttgcttagaatcaggaccagaaatgaatgtttatttgaaagatggcaaacaaagatctccttcttggtttaaaaagatgtttgaaaagagcatatgcctgtgttgcgtttttaatgagccaagatgtattttcaacatatatcttcccctctattgcatattacaaacaaacaaaaaattaacaaagttagcattctaaagtatgttcatagaatttcaatgctaatttaatgtgctttgaaaattcatataattcatcatctttttctttatatttagactaattgctcataggtatgtgttcaaaataaatgaatttaagcatgattttatatggtgtttttaaaataactatgcaaacatatttatttcaacagacaatattaatgtctgttgattaggcagatttcaaaatcgttttccttgtgtaccaggaaagtaaatggaagtttctttaatgagagcaactcaaatatttaatttcaatctggttgttgttattgttaaagggatagggaaccaaggtagcagaaaagactaaagcagaatttttttatggttttttacttttaaagaaaacaatacatttatataacaaataatgggattatagtggccactgtgcctacctgctatccccccacccccgccagccaccccgactacagcacacactgtctgggacactgctgaacaaaattacaggtttaggatttgatgtacatcaataagtcgcctgtcccgtggccgtcagttgcatgccagataatggtagcattatcatctttatttcttagcatctttactttagagctggaagagacagtaggaatcacatcattgaaggactacactttaaagttaggacctagagttagtaaacaatttttcggctgttgcatagttgagggccatgctgggacatgaatccaagtttttgccttccaagttcagtgactcttttcatcaaatcatgctgcttccctaatgttctcttttcttttttcttctttttttttttctccctgttttttgagacaaggtctcactgtgtcacccaggctggagtgcagtggtgagatcactgctcactgcagcctcgacctccctggctcaagtgattctcccaccgcagcctccccagtagctgggactacaggcatgcgccaggataaaatttaaaaatgagcctggctaatttttaacagttgaggtctatgttgcccaagctggtaattttttaaataaatgaaacatttttactggttgccgttagtcaattaaagtagtatgtgttgaatctggcaaaattcataattaggtttcagtaaatgtgtgttatatgtatttttaaaatctctgataacctaaagtatccttaagctaccagatggaaaatttaagtttcaacataggcacatctatgaatttttcttactgttgatgaatttaggttgacttgccttaagtcggaatgcaaacatgtatattttgtatattgattgaagttgttagtttgtcttagtgaaaaattggaagtgctccttaatgaaaattaacatttaagttgaagccacaactttgttccatattttttcttcctgtatttattagcttagtgctaccatcattgttttgactatactaagcactagaaagatgccagtgtgtgtgctgtagaaaaaagtttgcactcccatgactgtggatcccgactgacattcttttttctttttttaatttaaattaaattttttttagagatagagtctcaccgtgttgcccaggctggtcttgaactcctggtccttatcccagatttgaacccctgaactcttagcctcccaaagcagtgggattataggtgtgagccactgcacctaggccctccatcactattcttttatggcaagtatgcttgcagttgtcacaagaaggtcctgcccacgtttgctttagaatatgtgaattcaacttgaaatattatgctgctattaaaaattatattgtcaaaggctgaaccaacaaggaaaaatacttccatggtactggtaggtagaaatggtaggatttaattttatataactgattttaaaaaattacatttttgatataaaattcttggaagtaaatatatcacatagtgtatatagtggaaatatgcatgtcctcccccccttcacttttccttactttccacgctttttctagtaaccactttctgtattaaaataataaatttgagggagaaaaatctataaatatttatctttacagactagctgcggagacaactgggaaagttgtgtttataatttttcaagctcaaaagagcctactaaccaaaatgatacttgctcagtcttattaagcattgaaagtatatttatagcttattactccagtaactagtgttactgttactccatgttaaaaatgcaggatttgtacagaattcatgttaggtgcttttctgttttacttgtactaactcatttaatattaataaaaacccgtgaagcagtagtgatggtttttgctcttggggcctaaaaatattagtaatttttttaagttaacatagctaataaccagtgcagcccagatttgaactagtgtcacacaagagcctataatcttaagcattatatagtaattacctaaattttatgttatggtatagaaaaggtgacttagaaagaaaaataaagggaaaaatagtcaaataaaaatagtcaaactgtacctaatgtaagattttgcctgtaaactgaatggtaaatgttcaaatttctgtttgttgccatgtcatgtaaaaatggctagattgagtatcattaaatttagagggtacatgaggagccctataatgtaagctagatggtctacttgaaattatctttctggggtggatgtcaaagatgggcagtggacttctcaagtagctgaaacagagagataatgagagatttcgagccactgtggattaagagagatgagccttgtatataaagacaatgaggatagagaccaaattgtggtttaaaaaatgagctccaaatgaaggtcccaagggtaggctccaaattgtagtcaatctaaagttgattttaaaagcagctgcttctcttgtgggcaactgcatccagcaggagcagcagggattcctaacagaggttgataattcttctgaaaaaccaggtaggctagctagttgatcaataatgaattcccacatatcctgcttcaaataggaagtcaaatatgaaaaacgattttgtgaaagaggaattcaaagttttcttgatcatatttattataattagcaattttgttaatttctctattcttttccaaatcccattttcattggtgcttttagcaaggttataaatacctaacgtttgtgccttatgtgataaatagaataaagacattttaaaaatagaattttatggccttgagattatttaatatgtaattcaaatattttaattgaatatttgaatatttctgtaggtattcctttctttcacttactagtcaaagacagcatttccatcacctagcagaaaggaaatggatcttccaacctgggtaacatggcgaaaccccatctctacaaaaaaataaaaaataaaaaataaaaaattagccgggcatggtgacgtatgccagtagtcccagcttcttgggaggctgaggcaggaggatcacctgagtctgggagattgaggcctgcggtgagctgtgattgtcactgtactccgcctgggtgacagagcgaggccctatctcaaaggaaaaaaaaaaaaaaaaaaacagaaaggaaacagatctttattagctcttctggtgggaaatgaggatattggcatctgttgaaaataacctagtaaaagtttgttggattcatgaatgagtgcgaggcatgcttctagcacaataaaatacgtctttttctaatttacttatgcctcatagtcatgaacatcttcacaggtaggtgtaaatattctcattttatggagattaatgtacagagaaagtaatatggccagaggtggtgcacagtggagcccaggtttcacacagaccttctgactccaagtccattgttcttgtatagatgtatatatacatcacaagaaaatgctgtaattgttcaaagttccaaggataggcattgattattttgggtcaaaaaattagaagattataacttatttcaaaattcatttagccagagaatgttgaaccctaaacacaaagtactacgttattgccctgtggaataaatgaactccttgtctttaagaagcacataatgtagttgaggttgacatatacattaacaaaaagagcaaaacagtatttaattcatgcgtagtatatatataggcattctgtgagtgcccctagaactgtgtctcctgtcacatgctaggcatccaataaatattgattgattgaatgaatgagtctaaattagagtgtattggttagggaggcatttatggattagataagacttgtgtggcaaggtcttagaagacaactaaaatttagatactgtgagaaaggtggtgttagagaggatggcattccaaacaggagacacaggatgaccaaagaagaggtgagaaggagcaaagcccatgcagggctttgaatagagcagtttggctagagggagccatttatatagagtaatggaaggtacagttagaaataaccgctttgagccaggcttaaagacctttacatgctagattaaggagttttcattgtattgttcagcaatggctgctgtcaaagagttaaattccaggagctaacaagtgacattaccaaagtaacattttatgtagattgatttgcccttgaagctgggcatggtggcctgcacctgtagtcccgcctactcaggtggctaaggtaggaggatcacttgagcccaggagtttgaggctgcaataaactgtgatcgtgccactgtactcccacctcggtgacagaacaagactccatctctttttgtttgtttgtttttgtttttgtttttgagacggagtctcactctgtcacccaggctggagtgcagtagcgcgatttcggctcactgcaacctctgcctcctgggttcaagcaattctcctgcctcagcctcctgagcagctgggcctacaggcatgcaccaccacgcccagctaatttttgtatttttagagatttttgtattagagacggggttacaccatattggccaggctggtctcaaattcttgatctcgtgatccctcagcctcccaaagtgctgggattacaggcgtgagccaccacgcccagccgactctgtctctttaaaaaaacaaacaaaacaacaacaacaacaacaacaaaaaactgaagtttctggtttgctcttggtacacagggtgaatttggaaattggagagaaaatagatcagaggtgaaaagactagtgagagaggctatgcgttggttcagaacagtagggatggcattccaaatggactgagtgtctctgacatcaaaaagatttgtcagaacctgattactgattgttttgaagaagaggaagtcagtattttttttaaaaatagaattatatataggataatagtcttaaagttgttctctgagaactagtgtcttattagtgtgttctaattgagaactgccatgctatgtcattcacttaatctggattttagttttttgttatgttttacctgttgaaaaatataacacttaactgtttcagctcgtgctgtcataacaaaataccatagactaggtgactgaaacaacagacattcatttctcacagttccggaggcagggagtctaagatcatggtgccagcatggatcccagtgagagctctcttcctgtcttacacatggtggccttcttgctgcatcctcacatggcagggagagaaagaaagagagaaggggaagtctctggtctcttacatggacactaattccatcataaggatcccattctcatgacctcctctaaacataattactccctaaagacctcacctccaaatactatcacattaggggtcaggacttcaatttatgaatattgtgccccatagacgttgagtccatacatgtaattttaagccctttttggattatttatatcattctcttcttttcttagaggtaagtgctatccagaatttattgtgtattatacccatttaaaaaaaagtttactctttgtgtatttgtttataatatttagtatttttttaggttttaaagctcagttaaatagtatactattcatattattctgcaacttctttttttcctataacattatgggtttttttttggtgataatatctatgtagttgcaagtcagtcaaatgttgtgcagtattccattttgtgaacatatacaatttatcagtttttctcttgatctgcatttaggttgtttctaattttttccaatttcaagtattccggcagtgaacatttttgttcatgataccttacatagatatgacagtttctttagagtattacctatgagggtaatatccctagactgggttgtatgtgatttttagcttcattaaatattttcaatttattccaatttacattggagcctgaagtatataggttgacatttggtataagactttgttgttgttgttgttgttaagagatggagtctcattctgttgcccaggctggaatgcagtggcactatcacacctctctgcagcctctaactcctgggatcaggggatccacccacctcagcctcccaaggagctgattctacaggtgtgtactaccatgttcagctaattattttattatattgcccagactggtctgaaactcttggcctcaggcgatcctcctgcctcagcctcccaaagtggcggggttagaagcatgagccactgcactcagtcaatcccccttttttttttttgagacagagtttcactcttgttgcccaggctggatgagtgcaatggcgtgatctcggctcaccgcatcctctgcctcccgggttcaagtgattctcctgcctcagcctcccaagtagctgggattacaggcagaagccaccacgtctggctaattttgtatttttagtagagaagagatttctccatgttggtcgggctggtctcaaactcccaatctcaagtgatatgcccgccttggcttcccaaagtgctgggattataggcatgagccaccacgcctggcccactgttttttttaagacttaatttttaataacatgaggggtatgaaatggtatttcactattcagtttcattatgcgttttctgattactgttgagattacacagtgcacagtggccattctgattccttcttctgaattgcctgttaatatattttgcccatttaactgtagggtgattttgtttgtttgttttttttttgagatggagtctcactctgccgcccaggctggagtgcagtggcgcgatctcggctcactgcaagctccgcctcccgggttcacgccattctcctgcctcagcctcccggtgatgttttttatattgacttacagatattgatgtgtattccaaatacttcaggtggaatttttaacccttggttaactagctctgttaatatgatagaactctatatcagatcaactttggtgaaaaagatgaccttttttggaaaaaggatcataccacttacatgaaacggagtaatctgtttggtcactacagttgtgcacccttatacgtggtttcagttatctgcggtcaactgtggcccaaatttattgcatggaatattccagaaataatccatgagttttaaattgcatacggttctgggcattgtgatgaaatttcccgccatcctgttctgtcctgcccaggaggggaatcctccctttgtccctcatctccacactctatgtgccacccacccatcagtcatctagtagccggcttggttatcaggtccactgtctaggtatcgcagtgctagtgttccagtgacccttatttgacttaataatggccccaaggcacaagagtattgatgctggcaatttggatactctgaagagaagctgtaaagtgcttcctttaagtgaaaaagtgaaagttattgacaaaaacaatcataggctgaggttgccaaaatctatagtaataatgaattttctatctgaaattgtaaacagtatattgttataattctattttattattaactattgttgttaatctcttactgtgtctaatttataagttaaactttataggtatctgtgcataggaaaaaccggtgtatatacagttcagtagtatctgtggtttcaggcatccactcgaggatgagggggactactgtacttcacttccctaaagataaaagaaatacaatctctattgcatcaaggctgaaattatagcagccttctcaggccttcttgcctcctcccacattgactgccactgtttttttagcatttgtgtccactggccccattgtccttcctctattaaatgtccaacctgtttaaaagttggtattccacttgttgagagacctggccttgcctggcagcatgggtgcttgattttgcctttgaatctttcccgcagcagtaccagccaagctcgtatttgggctatgattcaaggaactgcaattaagagtaaccctgattcaactttcccatcttctctcctctttgtaaaggtactttaaggtgtgtaagttttaaaaatccatatggtaactcctgtaggaccagaggactggacatgttgattatcctgtgcatgtgcttaatcattaaaattatatgaaagttagtacagtaaatatgataacagttaaaagaaccaagtgagactctgggtttgaaatcaagctctgacagttactataaaatgggggatactataaatatctgcttcatagggatgttgttaaaggagatatatataaagtgtttaccattaggcttagcacttaataagcactcaataaatattcgctggtctcaaaattaatttgaagctttgatattgagatggtattagagtgtgaggtgcttgctaattttttatattataattattttataatatcttctatatatactgaagttttaaatttttaacttattttacatgttttcctaaatgaagacttagatttatctgcagtggttggccatcatattcgctgtttgctgtatccacttttcccccctcatctggagcatgcctaccattttgtactttttaaaatttttttctataaaagcatatcgtcatataagcaagggagagggttagctttgaagagtcaccttttatgtaatacgctgttttatctttactatcacctataataggggctcgggtggtgtggcatttcccagtaaaatgtctgctttgttcactcactagtttatgtttcagtaattattgtgattattcccttttttggtaagcgttttgtaaatgttttagttgttaatcattttttagctagaaacttttacttgacagtccatttattattattattattattatactttaagttttagggtacatgtgcgcaatgtgcaggttacttacatatgtatacatgtgccatgctggtgtgctgcacccattaactcgtcatttagcattaggtatatctcctaatgctatccctcccgcctcgccccaccccacagagtgtgatgttccccttcctgtgtccatgtgttctcattgttcaattcccacctgtgagtgagaatatgcggtgtttggccttttgttcctgcgatagtttactgagaatgatgatttccaatttcatccatgtccctacaaaggacatgaactcatcatttttatggctgcatagtattccatggtgtatatgtgccacattttcttaatccaatctatcattgttggacatttgggttggttccaagtctttgctattgagaatagtgccgcaataaacatatgtgtgcatgtgtctttatagcagcatgatttataatcctttgggtatatgcccagtaatgggatggctgggtcaaatggtatttcctgttctagatccctgaggaatcgccacactgacttccacaatggttgaactagtttacagtcccagcaacagtgtgaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcagacagtccattttttaaggaatagattccctttaaaataagtgttactgttcctgcttttaaggaaaacaaattgacagccttagtatctttaagagtagaacatggatgttagtgtactattcagtaattttaaattgactgtataattgtgcttgtgatagttaacactagaagttgaacagttaatttgttcattataatgtttaaagcaaatggttaggtatgtgcctaccttagccccacatgtagatagacccttcatcctcattagactctaccttgttggtttagagttaaaattcatttggaagtttcaggccaagaaataatacatttgagatgttaaagactcatttccagccagacgtggtgcctcatgccatggtgcctcccagcactttgggaggctgaggcgggtggattgcttgaggccaggagatcgagattagcttgggcaacgtggtgaaaccttgtctctacaaaaaatttaaaaattagctgggttgggagatcacttgaacccaggaggtcgaggctgcggtgagctgtgataacaccactgttctccagcctgggcgacagaccgagaccctgtctcaaaaaaacaaagcaaaacacagaaactcacttccattgtctaagcatatattcatacattgacagcatctaagctactggaaaatggatctttatttgattttgctttaactttgttaaggagggttatggttgtaactttgtttcctggtagtggtgttgaccaggaagggatgagttagaggagttgtcttgttgtcagattttctttacactttgtatttgactcatcctgctggctaataacccttgtgtttaacaccgaatcagggactcagtacagtgaatttgttctttattcagccattttaatttctgtttacatatggcatagtgattcccagtcataagacttttatgtgcgagagctctcttaataacaaaacacagaagtttgtaataacatttagtataaggattgaggttttattgagtgattcttatttttatttaatcattgctttgataatattttttcaactgaagtttgaggttaagtgtctaagactctaaattctatttctagttttatatatttaaatcatggtaaagttttacgtacataattgctttctatatatttcttcatctaacattttacaaataatagtaatttctcttccatgtcttttagtaataattatttttctctatgaaaccctttatgattctctggaataaaatgttattgaagtataacaaaataattgtgactaccatcaaatttaagtttacattatgtaccaaggtatcataataagtcctgtagggaatacgaagatgagtaatagaatcactatgctggtctatttcatgtttataatatacttagggcaaaataagtacatagacagtaataaccatgatataacatgaatagttttctacttttttgtccttatttcctgatacaggcacatatttatagactgaccaaaaggctctgtcagcgtagtccattggtttcaggggattgagagagaggggaaggtctcacttgtatgaagcacttaagaaaggccttctgaggcagcagctattgagataataaacctttgagggtcagtaagacttaggcggaagatggaaggaaaggtcactcaaaatgtaaggatggaaagcatgagcagtgatctgtctgcataaaaatgccaggccaagtcaaagaatactgcacacagtatgagtttggttggaacgtgcaccatacagctaggggaatatttgatggacagagctagggaactgggtagattgcagaggcccctgaatgccaggtcactgttttgatttcacagagagtaagaaaaagagaagtgacatttattgagttcctactatatgttaagaactatgttagatggttaatataatcatgtttaatcctcaaatcagtactgtacagtaatttctatctccatgttacacatgagggaattgtaacctaataacttggtgctaattataggatagattgagtaagggagagacctggcatgagaagaagttattggtggtggggttactgaagagaaagaaatcttgataattgtagagggattggaaagaaggtgatgtgatgaagagaaactgcaaaagtagaatctaaaggtcttggaaattgattggatttgaagattgagagaaaaaaggagttaaaaatatttgctggtgacttatgaaaagtagcagatacagatttcctgtctcccctctcctggggaaaaaaaaatagcagataaagaaaaacttcctcagaaaggtgaggagttcaattttgggtacatttagggagatacgtttatgagagcttgaaagttgggcacgatagtagctaaggtgatatcctgaagctacaaatgaaaattgggtctcatttacatgaatatgatctttgatactgcatcagcagacaagatttcaaggagcagctttgtagtgagaagaaagggcaaggatgttattcaagaaatgcccattgggcattacaggtggttcacacctgtaatcccagcactttgggaggccgaggctggcggatcacttgagctcatgagttaaagaccagcctgggcaacatgatgaaatcctatctgtacaaaaaatataaaaaattagccgagcatggtggtgtgcctctgatcccagctactggggagactgaggtgggagggtcacttgagcctagaaggcggaggttacagtgagctgaaattgtgccactgtactccagcctgggtgacagagcgagacagagtctcaaaaaaagaaaaaagaaaagaaaaaagacatgctcatctttctttttttttttttgctgttgttgcggaggtggggctcagtgacagggagacgcagatccaagacagatcagggaggtaggaagggagaagcaagatactgccagtgtcattgaagccaagggacaacagggaaaaagttttctggtagaggccaagttgtacaagacttcagagaatggcaggaaactatagtctctgtgtggttctcaagggccagtgaccctatggcatttggaaaggggcgggggtggttttggcagtagcgatgtgaggcgtgctgccttagtttagcaaagcacaggggaggccccgacggccccatctcagatgtccacctcctgccctcttctctaatcctcctgcctgctgctctttctccttagtgcttatcatcatcttacatactatgtcttttccttatttatcttgtttattgtctgtctctagattgttaggtcaggagggcaaagatacttatctgattggtttgctgctatatgcagtgcctagaacagtgccctacatttaggaaggaccccaaggaatggttcctgaataaatgtatggcaattatagtgatttgaataactgacctttctccttcaatatactgtaagcttcttaaatggaactgaatcatctttgtaaccctatgtattgtaactgatatatgaagttttatttatagcagcatcagaagggaaaaaccaaggatttgggactcaactggtgtgagtttaaatttcttctgttcttactaatttggccccaattaaactaccagacctctctctgagccctattttcttcagctgtaaagtggactaaactagtacctctgtcatagggctgttgaggattagaagatgacgcctatcagagtggctggcacattgtttgtgcccagtaaataactggtgttttgcagtctttctactctgtaaccttgagtaatttacttcacttcactgttttttcatctctaaaaggggaggatgaaaccaatctcatgagatttggaggaaccaatgagacagtaggcacaggtgccctctgtttttgtattgtgattgagagcacagactctggaaccagactgcatgaattccaatcctaacccatttactttagctttacttgacttttctgtgccacagtttcctcatgtgtaaattgggagacataacagtaccagctccatggtactctgaaaaaaatggatgtgaatattaataaaaagcttagaccaatatttggcatatggtaagcactaaaagtgtttgatttaaaaaataataaaatagtatgcctttattgcttttttctttctcttcagtctgtcaaatggtataaagaatggggcacctttacaatgaagtcggccatgtttatgttggaaaatataatgaaacaacaaaaacaatactactgcttcttcatggtttgacctgactgggtaaggcagctgtggtcccaaatcttccatgcagcagcactgtaaaatctgtcctttagtccctgttcttgtcaagattcacttactactagcaatggcagcctggttgagagcttgtctctgaaaaatgtttttgtcacttgcaaatctgcctccatttccttgcctcccgttctgtcagctggtctctaggaatggttaggaatgtagtttgagtagaaacctgggaggaagcagcaaaatgagagggacaggtggtgagtggctggccaatctggaaaccttcccctcttgctagggaaggttttctgtagtagcagtaacaaaactctaagaacatatccttaaatgtgtctctcagttcgttaattctgtcaagggtaaaaggtttctgtatgtaaagaaccacagagcttattacatcactgaggacttggctgaatctttattcacatccaaaacagacttaggaaggaaaggtagcagcttcaagtcagcagattcagcttccattcatgtagcaagctgctgttggaaaagctgttgtgtgtagatcttctttccattagcagaggttctactggatcttctttgtgtgtgattcatcgttatgcctaatctgcccccgactctcaccttggtgctggggtggcaagcatgcttcaatctctggtgccaattcctattgattatagtgattgtgtggagtgctgtgttgaggagaattgagaggccacatacaggcttaaaagtgatttaattggcaatgtctgctgtgtgaggggagaggaggtaaccacagcatatgtgttgtgtatgtgccgaacgtgatagattccacgatagggctcacccttgagagattcaaagtcacattttgtgtctgtgtatttttgtctttgaattggtatgtacatattactgtattacacagtaaaatataaataaactgggaattatcggttagcttgggttatatagaattacctatgtatgcttttcatggcttgcttaaagcgtggatctaaattattattctttcatttctgaaataaaattatctatacttttctacactttttgtgagtttctcttgtttagttgatacatgattctgatctcctgttttttaagtttggcaaaaaatacttttaaattcttgggtaatttcacttaccaaactactgacaaattaacatgagttgcttgaaaccttgggcacacaacaggtggttgtgacagactcgggggttccaatcattgtagaacagaccagagatctctttccttaaggaatggtcatgtgtctgttgccacttggcttctctccttatgggtcagaggtaatcctcagtttaaccattgaggtataaaagtattttttaaattttattttgttttccttcttgtgaatcaaagtctttcctaatttggcagctgacaaagaatactctttcattgagttagaatgttgaaagtataagcaaaaatttgagaggcactttttacatttgctaagtaaagaaatatttatattagacttttcaaaaaagtatgataaaatatacataaaattgacccttttaaccattcttaaatgtatagttctgtggcattaagtgtattcacactgttatacagctatcaacaacatccatcttcacaattttttcatctttctttacccgttaaacactctacccattaaactcttaactccccattcctacctgcccccacccccgcccgcccctggtaaccaccattctaattgctgtagctacttaaagatttgactacctcatgtaagaggaatcatacaatctttgtctttttgtgactggcttatttcacttagcataatcttcaaggttcgtttatgttgtagctggtgttaaaatttctttttcatggctgaataatactgtattgtgtaccacattttgtttattcgtctgtcaatggacacttgagttgctttcaccttttggctattgtgaataatgcggctatgaacatgtgttcttacatctattcaagtccctgctttcagttcttttggatacatacccagaagtggaattgcaggatcatgttttttgaaaaatttttgttttccacagtggctgtgccattttacatgccatcagtaatgcacaagggttctagtttttctgcatcctcaccaacacttattattttctatatttttgatagtagcgatccttatgggtgtgaggtagtatcttattgtgcttcttatttgcatttccctaatgattagtgatgttgagcatatttccatgtgcttatttgcccatttgtgtgtcgtctttggagaaatgtgtattcaagtcctttgccagtttttaaatcagattccttgttttttgctattgagttgtaggagttcttcatatattctggatgtcaatcccttatcaaatatacggtttgcagtttttttgcctgtccatgggttgccttttcactgtgttgatagtgccttttgatgcccgaaaatttttaattttgatgaaatccaagttatttttcttttattgcccatgcttttggtatcatatataagaaataccaaatcctgtgtcatgaagtttttcccctgtgttttcttctaagtattgtttaacttttactctcttacatttagatcttgtaatcattttgagttaatttttgtatgcgtaaggtaaggctccagcattattctttttcatgaggacatccaattttcccaatactatttgttgaaaagactatcctttccccattgaatggtcttggtgcccttgtcaaaaatcatttgaccatatatgtgagaggtttttttgttttgttttgttttgtttttttctgggcggtatttgacattttaaggttaagttcagagtttcatcatttctcagtgatattgcacacttcctaactattgtccctaattcaagtatcatttttgatacatttctactctggcattctgattatgttttctaggttttgcctgctcttctattttccctctttgattatgagtccctggagggcagggattttgttctggagacctagtgccttatgcgtcattggtactgaatatgtgtttgttggatgaaattaacttagagctaaaaaaagaaagaactagaagacatcaagttaggtataaaaagtactttttcattattataaactattactatggcttatgagcctttaaggaaatatgtcttttttctgctaatggtattttccctcttttcccatgcttgccactgtgactgcagttatcaccctcttccttacaaggataaataatcttcacaaaaatttgagaggaagacaagaataagtagaaaacagaagaaaggaaaggaaaggtgaaagaaataaacctcattcaaaagcatttaacagtacacttgaagttgagtcagaacaggctgaaggtgctaagaagcagtgatatgctgtgagagatgcagtcttgcagacaaaacttaaaacacatgttccctagcaccttttgtcacaagtgtctattgtgcctgttgaaatttggaatagatgaataattaattatttgcctcagaatataacatctctacaaagagtagccttttgtcttcgacaattctatttgtatggtcaaatctgcgaataaatgaaaacattaattagtctaatcttcatcaaagtaggctgtccaaaaaaagacataaaaaccttaataccaatgacctgtgtaatacttgatgcattgaggaaccaggtttcttcagggccctaacgtatgtgattgtcactttcttttgactctatttgggaaaagttaatacataggagaaccagagaatggtagagtcagaagagcaaatctggttaacccaccagagttaaggatgggaagaagttatgtagggccattaagccatcatggtcagagcatatgttgtaccctgaaagttccattcactctaacgttttattttgttttattttttaaaaatagatacagtgtctcactatgttgcccaggctggtcttgaactcctgggctcgagcgatcctctgacctcagcctcccaaaatgctgggattacaggcgttagccactgcagccagccactaactaccactacttaagtagtatgatcttctctctgctttcagttacttattgacttaataacagtttgggagattctccttacttagtacgtaaatgattctaaagctaggcacattcagccctccatgtttgcaggtttcacatctttgaattcaactaaccatggatcaaaaatattttttaaaaccaataaaaatagtacaaattttaaaaacacaatataacaattatttacatagcaccttgtataggcattataagtaatctataaatgatttaaagtctgtgtgtaggttataagcaaatatcattttatatcaggaacttgagcatctgaggatttgagtatccatgggaggtcctggaaccaataccctgtggatatagggaatgacagtactggaaaagtctaaccagagacaatggttatccaagtctgagaatttgaaacggatgactttgagattcccaggcctagatggctctcacattctttttagccccttttaaagttctagttgttcattaaaactgtcagagacttatttgggagtaatactgatctcaaagagctggattaatactgaatcaaattcttgggatctttctctgagcctttggcatttttggaagcccaaggtttataaggtataacctggatagaccattagggttctcattaactctggttaacagatgacttaagaatttcagttttaacctagtgatactccactgacttcaaggagtaaatacatttttaaaggcgacttactttagagtggtttacagtgtgctaattaggaagaatttaactcagtcatttcaagcctctgaaatccttggatgaagtacaaatgctgagatggaaatgtagtatgctatttgtatattattccatttcatgaagtggtaacttggcagagtcgtatttagaagtgattgcactctatagtccttctcctcagccctcttttgtgtgggtataatctactgcagtagtatcatagacatttatgcactgctgtttgcataagctttttattggaaataacccaacaaaatagcagtccctgctagcttagcacagttgggccttttctaaggctcattttcctacacatcaagaaaaaaaactctctagttaatgttagtgggatgatacccacaagcaggagattcaaagatggcccttttctttatccctggctcacctgaggaaggaggtcagaggcccaagtgacttaattctatgcagatctatgcctaatggaaacaataaattcaaatgggcagtattactttttcccttactatcttactatttatgaaatgtatttctcactgcatttaaaaatgtatttaacatataaattatttcatgatattttatcaggttttaaaaatctgatatttagctgtagtatggaattacaatgctaatgggtttacaaattaatattacaaatgactgaaaagttcacactctgcaacttgttaaacatgtcaccttcagagcttatctcatttttaattaataaatatgtggtcatagtgtgtaaagaagaaatctttatagattaaagatttgtcaccttttggaacagtggactctgttttttaacatttgtattatagaaatttagaatagtatagtaaacttccatgtacccttcatacccagcttcagaagttatataaacatttttgccttctttttgaaatggggtctcgccgatgcccaggctggagtgcagtggcacaatctcagctcactgcatcctctgcctcctgggctcaaatgatcctcttgcctcagcctcctgaacagctgggaccacaggcgtgccaccacgctcggctgactttttttttttttttttttttttttttgagacagggtctcactctgtcaaccaggctggagtgtagtggcacaatcatggctcactgcagaccttggccttccaggttcagatgatcctcccacctcagcctcctgagtagctggagctacaagtgtgtgccaccacacctgcctaatttttgtatttttttgtagagatgggtttcaccatgttgcccaggctggtctcaaactcctgagctcaagtgatccacctgcctctgcctcccaaagtgctgggattacagggcatgagccaccgtgcctggtctttgccatgtttttaaatgatgaaaacgacattactaaaagtttggaaattaggatgaaaatgacctctggtctcacccagtttaactctcatcatcattttttggtcttcttcttcttcttcttcttctttttttttttttttttttttggaggcagattctctctctgttgcctaggctggagtgcaatgttctgatctcggctcactgcaacctctgcctcccaggtttaagcgattctcctgccttagcctccgagtagctgggactacaggcacacaccaccacgcccatctaatttttcatatttttagttgaggcagagtttcaccatgttagccaggctggtctcaaactcctgacctcaggtgatctgcccgcctcggcctcccaaagtgctgggattacagacatgagccactgcacccggcctacagttttgatatacagatactgtttcttctttttgctgaacatgatatcaaactaagagctaatggtggctaccatcaattgatgtcttcctatgctatgcactgggccagttgctttacatataattcatagactcttcacaataacaatacagtagtataaacatcctctctaccccagagacacacatttatagataaggaacctaagacagggaggttaagtaacttgctcaggcactgcatatctggcatatgtattcgggcaaaagtctaactctgagtgcatgctctttcctccctctaaagtggcctcttcaaaagcattttttcatattgcaacgtaatcacctttttaaggaaaaagaaatatcagtatgtaaattttgaccgtgtatcatatagaagcagcactaggacagatgctgctgtgggttagagggataaaaggtatggtgtctgctcttcaatgtcagtgctctaatgctgaggagcctgccccatcgggtacactaacaaagaaaatgcatggttagctcaggcccaccctggttatctttctttcttagagccagttgtgccatgtaacataaactaatcatagaggtaaaaacatctgtcatatttacagtcctaggaaatgtgcaggacatgtccatccggggggtggagaatcttgcagaaccacgtcagaattctgttcatcacaagctcccaattggaaacaacttaaatgtctaccaataggagaatggataaactgtggtatattcatacaatatcctaagcagtgaaaagggacaaattgttactatacagtcaccctctgtattggtgggttctgcacactagattcggccaacctcagaaaatactcgggagaaaaaaattttgtctgtactgaacagtgcagacttttttcccctgtcattattcccgaaacaatacagtataacaactatttgcatagcacttacattttattaggtatcataagtaatctagagatgatttcgtgtatatgagaggatatgcgtagattatatgcagattctataccttttatatccaggacttgagcatccatggattttggtatccagggggagctcctggaagcaatcccccaagaccatgcagtaatatggatgcgtctcgaaagcttggtactgaaaggagccaggacatagagtacttactgtatgatttcatttatttaaagttctagacaaagcaaaactaatctgtggtaacagaaaatcagagtatcgtggttgttggcagggatgaggagatgtggagtttgcctgagaacaggcacaagagaactttgcagagtgatggaagtgttctacattttgataggagcctggattacagagatgctttcatttgtctcaactattgaactttactcttctctttagatctgtatatggcactgaatgtaaattgtacctcaatttaaaaatgaaaacattactctattgaatccttgttttacttctcaccagactcttggattaagaaatgaaccaccattatatacaaccaccatcataaaatgttaaagctaaaaacaacttgacaaattatctagtctaattcccttgtaaacactactgccttggtgaagaaaaaagtttaaaattgctaatgataaaatctgctgttgctatcttctgcactcaggaggagagttaggcaattttaccaattcgtgtatgccagcagaaaatatgagagagggacagatttgctaacagcaatacatcttgaagtgtaagcacagaatctggatcaagacattttacttagatttgtttggcagaaggcattatcttagctgcgattgatctggtcagggaatgcacagcattttgctgctgcccatgatctggctgagaaataatttgtaaaagcgccgttgtagttaataaaggacacatggtgttaatgttagcgtgtctgtgacctcacgctctctctatggaagtgatctataagattgccaaaggtttcatgaccttgtgagcagaaaaagaacacatttgggtagacggatttcacaaaccaccccctgcagttttttgctagtcttttaaaactgcagtcattgcattgattttatatgttgccttggctgattattgattttagtcattgcattgcattgcattgattgtatatgttgccttggctgattattgattttagattttaagtccataatgaaaatatttaggtggtggtaaaaatcattataacttttaaaggttctttagcaattaaaacattatcttaaaaattctgaattgtgcttttttgtgttttcattatgaggtgttggcataggctggtattttaaattttttatgtttattttcttcatctctgaaattactttatttcctaattgaatttctttgctcaggtctttatggaaacttatgttccctgacacctcactaatcatttcaggctctgttagttgttagtgttgtcttccagagtggccatggttcccttcagtgacttaaagagaattagtaaacactcattctatcctatttatttctatgttgagtggttaattagagtaaactaggagttttggaattggagttgttaaattctttgagttctgagaacttagagaattttttgtatagataacttttatatgataataatcccttctggtatctgtaataattcttggtttttctgtattaaagaatataagtttggcttggtttacttatgaataatgcagtttatgtaaaatgattttgtgaaatgaaaactctctgtcttgatctggtattaaaataatccatgaagtatctacacacaaaagaaaattaatgtatgattccacttatatgaggtatctacagtactcaaactcatagaaacagaaagtagagtggtggttgccaggggctaggggaggaggaaataggagttgttaaatgggtgtagagtttcggttttgcaagatgaaaaagttcaggagatctgttgcataacagtatgaatgtgcttaaccctattgaactgtacacttacaaatggttaagatgataaattttgtgttatgtatattttaccacagttaaaagtaaaatatatatattaaaaatatgttttgcatttatgagatgaggaagccagttacaaccaagaaatgtaaaatatagtttaaatttctgttgacttcagattaacagaatctgtcattcttttagtctcctcgtgtacagcattcttcactttgcacattgcacttgagcgtagttccttacaccatctttttccccactttcaactacccagcactctcacatttaaacttcttcctcaaattgcttgcttcatggattaagaacaatttttaatgtgaaacaaaccataaccaaagataaagtaggaatataatgtgatcagctgctttcttttgatctggtgcttctacttgttactaaggacatttaaaaaaaacatggagcagcctctgtgtgtcaggtactgtgctggtgtttccagatatgtgttttcagagttgattatttatcagaaatggacaaaggtaaccagccttaaaggaacttctgattattattttttaagatgctttggccatgggaatatttttcttcttgggacaaattataaattacttaataaggatatattcttaacaagactacattttgatgttaaaaagtatgtttacatgtgttttactaatacagggaattaattctcagtatgtggatagctataatgtctccaaagtgttcattatgccaggtttgtcagatttatatcattgagggcaaagctcaagagagtatatatttgcttttaactgcccctcactgttcatggccagtgtagtacatcctagtgaaaggaagaccatgcatcagaatgtttgttttgagcatttatttttagcagcagatctagaaattatattttcattttagggtatatattttttatttattatgaacattccaagactaaataattttagacatgcgtatgtgagtgcatgtgtacattgcatgcacgtgtgtatgtgtatgtgagagagtgagagactgagtctgagactgtgtgtgagagagaaggagagggagagagagggagagaaaagaaaaagacattcccttaatagcaggaggggtagaggcttactcagtctattatcataaagctctgctaatgtagcttctgagtcatgtgactgcagaaaaggctattatctcaatgaaaaggaaaccgggttttagagcaagcaatagaatagaagcaggaagaattttcgagtgttccaccatgctggattgtcaaagggggatctgtctgatcagcagctaaaaaaggatttgtgtggctagtttgtcagctatcgttagaaacaaatgatagaggagataagcggcggggtgctcagcatgtgcttaggtttacatcaagatgtaatgttggtttgggttaacagaggagatttatctctgaggcaataaatttattgctaattgtgggggtttttgttttgatgagtgatgtatggtatttgtatttacatcactggtgaagataaagagaagctgctgagctctaatatgaactgcagaagctgtggacagttacaaggtgtgtttcagaagtgctctgacttaatatttggtaatgttcttggaattctgtgtgcttgtggattggatgtgcggtgcgttgtagaagggagaactgagcgtgacaaccaggcagtgataatgttctcaggaacacatagatacagtgtgacccaaattgattccgtgttccttatttcttttgtgtttgtgtagtgtttttaaaatattccttgtagtttctttatgtagccaaatacagtgtcacgcttgtttgtaggaaatattttggtaagcattttctaaaattcaggaggagaatcttaattttttagatgcaaatcttaattattaaggaataaatataactataagctttatctttctacctttatactttttatccttttctaatttcaagcttaaaggggagctttgtgataaatttgaaattatttaatttttgattacatgataagtacagcttttatttttggtggaggccttgattcagtgatttttttgttgttgttatatatagtacctaactttctcagattgatcttatgctactgtatgcagagagctaaataacatacagttaatcttcagactgtacttgtctgcttttgctcatgttaatgctattaattctcatagcagtctgtacctgtctcttaaccttggaaaatgtagcacttgaaagtctgagattggtgaaagataatcagaagcattatctgaaaagggttaacaattacacaacatatattcggagaatgattttgctaatgtttttcatttaacttctagagcagatgggctgaagtgtatgtatgtttccaaatcacatatgattttgaaactaaactatactgtatacagttcccttttgaaattgaggttggaagaggtaaggaatgtatcaggcaatttctaaggtgtatagacagtttaacaattaattctcgctgtcttttctaataaaagatgagagcaactcaaacataatttttaattatactaagtgcaggagattcttctttatatctacaagccatatcttagcacagtatagtttaataaatcattaattttattaaatgggattttcttttaaaaagcagacaacactggcactttacatagaaaaacaacttggttcaaataagcagttaatttgggattttttttaactatcgtattctcccacattctttttttttttttttttccattttttattttcactgctctttcagtaactctcatgttcttgtaagtagtctgtgagacagggttacataccattttcagggttacataccattttccgcccagaaagcactagcaccatatgttaaatattttgaataataaaagtttcaaagttgtattatttgagctttctttgtttttctttatttttaaatcttattttgttaccttatctaagcctttgaatgagccaagacttttgtaataattaaaaggtatttttattgagcacctattattattacaagccactgtatgaaacaatatgggaacatgaagacaaataagatatttaatccaataagttaacttataactggcgttggaatccagcctcagtaaatgtaattatcctgtatcttataggaatttaaaatggctaaaaggaataaaacttatctgactgttgagagagtacttctctgattttgtgaatgacgtttcatatgagcagatttggatggtagttgtaactggtctgcctccatgccatttcattttcctttgtttcagaacagaaatactttttgttttttaaataatcttctacagctagagtagtttttattcctgatggttttgtttttcccctaggacataaaatatcagtcctttgcaaatttaaagtattttcataaacagattaacatattgagttatctaaacaaacagtatttacttttagaggttggggagtgaggaagcaccccagtattattatcagagttaagaggtgcaggtgttgaagtccaggtagcgtgtaaacaagccagatgtctagcttgcaaatcctgctacacttcagaattccaaccacagtaattaaccacaaatattataatcgggtctgatcttgtcaggctgagggggtttgtttcttggaacgaattttaatttgtagaatagatagggtaagaaaaagtagaattaagtgtgatcttagtattcagtgttgtaaaactcagtgaaatgtgttcataggacctttttgttttttgagaaggtaaaagtttgggaagatttaggcaggattaaagtacggggctatattttagagacatttgaattctgtggaagccaagggaatataagattcaggaagtggaaaagcctgtgtaacagccagcaaattttcccacggtacctcttataggatttgctctaaaaattatcattcagaaatgcagaaaaaggtttagaatcagttggcttatccatttctctcacaggtgctttggtccttgtcattaaaaaggtaagactttgcattttttagcatgcgttttagtagtgatggctcttttcaccaggttcacagttaacatgcagggttatggcttgtagtaatcactaatatagtacaacataaacatacatttgcattattttaatgttaaagataacatggttattgctatgtatgttttattaaagattttataagaaacaccaaacactataatcttgacattgaatgattgtttcttctttaaaagtcagtcaagattaagaagtatgttgagatagaagctagatgtttggtttcatcattttagatgtcaaatccaattacaatagtaaattgattggctagaatagtcataaaagcatactatgaggcttatgtttaagttacctgttttgtttctataagtccttagactgtagtcaaaatgaatgataaataaacatagtattgaaaccgtaatagcctttttatttttagttctacattaattggtttttccaaattttgctttcatgttttaatgtgaaaatgtccatttttatatgtcatttttacatatgcttattaaaaataaaattttaaaggctttgtttttactttttcttttgatgaggaaaatgacttttgcaaaacaattaacggtagttttaaagcttatcttttatgtagaacttacatgccaggtcctgttctatggaccttacatatattaattcaattcctgtttcacagttgggagatggagacatggagaggtaaagtcactggtccaagctcacacagctaatgagtcagtggtgcaggatttcagcccaggtagtttgccttgagagtctacactctaaattactatgtatattgagttcagatgatgctgggttcagttagatttgctgatttattctagaatgaggacaggatgaacataatggacaaggagggaactattacagttgaagtgattttttgttttttaatgtttgtactttagtgaacttctgtttcatttcaagtatgttaagagtaagacattatttaaagagtattcggtccgcattgaaaagaaacatattcatgaacattaactcccagctaattcagaaatctgctttagaggaaggagaatgaaggagagcattaaaattgggatagcagagattgttaaaacagagtgactatgaattgccatgagattaactgggtggggagaagctttgtagttctgggatctgaaagaagtgtgttgcatattttcttacttagtttcttttcctttttcttggcaaatggagaacttgctgcttccaaggtcctttactcactgcattgctatgatggagcattcaggtataaaaaccacagagaatccaaataaagatccttgtttacagataccagggattccataaagaggaggaaggtatacagacccttcccaagcccatagtctttgaatcagtaactacatgttagaagcaattagaagtccaccttccttggtaggacataagagcctctttcactatctggacctgcccttcccacttggagattctcacctagtcccatattctacctttaatgtaatagcattgattctcctgatttcacaggagttatgttttataaagttgtgggaaacattgaactggcgaattctgaggcatggctcctagtggaaaattgagggctaggttcctgcaggcctctggtcacatcatcttagtcatctgatcaatacataaccttatgtgtatttctgtttaaagacaacttatttaatatgtaagttacataatattgttgattcattaagattgcactcacagtcaacagcaatgtaactcctgccttaacaaagcttgtctaacattcatattttctcataaggcacatcacagccttctggcacttcggaaccctctatagcgttccaacatcacgcttgggggccattttcaacatcagaagaacaaaaatgcaaaaaatgtggccctaaagagactgaagaaagataattgctttacagtatgagatctgaaacaagacagagcatctcctgtttgaatagggagtgttatttgtggagtacctacaatgggccaagtgtttcagataataatgacaataatagtgaaggcagcttatttttatgagggtgtttctgtataccaggccatgtacttttctgctttatctcatttaattttcattcaaacttgtgaagtaaatgttatctgcaaatattacagacatggaaacagctttgaaaggttaagaacctttcctaaggttgtgcagctagtaaatggtggaagcaagaaatgacactgaagcttgttattatctggaggttcaaggccgtgttaggagatgcagtcaaatagggctgcccttctcaacagagcttctttgttggaaaggggtagagggccacatttccccaaagcctttgtgtctgtgtgatagtctagatatggaaatctggaaggattgggcacaagagattatttcctgtgtggagaggttggagaatcatgaacttgttgactgtagtagcaaaggtggtctctcagtctgcttctgctctgcctgtcatgccagctaaccaacctgttcacactctcactgtgtatcttttctctgccttgtaactttggctcattcatttcttcttgtaactttattatcttgtggtttcttcctatgtgtctttttagctgttgttttctcttctcactgaacaattctctctcttaattatcccaaagactgagagaacctgattgagccaaccaatcaccattgtctttgtctggatagaacttttgtgccaagccatccctctagaccctggcaacctgtagattggatacctgaatcaagtgctggggggcgggcagtgtctcatggtgttgtcagggtgtcttctgtgtaaggagatggagaaaagctgccttatatcagcaggttgtgggtccttaggaagagctgtgggaatggattgtttggtccagaatagagtgcagtggagtcttgtactacatgacatttaccaagaagatcaacaaagactgtaggtcttgtgtttcttcatgcctaaaatttgaagaccaatttaaattctctggtttttctgcttggtggttggtagaggttagtctttcatttagatgataagttgttgtatatgtttatcagaatgaaccattgttcaaatatattcagttgccgttgcaaggccgaaacagaattcctgtaatgacctgtttgaggccccttctgtcctacccggtttgatctcccatcacctccagatatttcaattcccaggtaaactcaaggcagttgaaattatattctggaacacagtcttctaaagttgattagaaatgttatcagagtacctaggattcagtaggaaaaggcaaggtagtggatgtaaacagaaggtggtttcttatacagaggttaatgtgagcagaacacaccaaagtaagagaaatcaacccaactactgtgagacacaaaaatctgttgtttctctagaatagtgggtcaagattgcagatatggagggaaatggggacacagttgagcttatgggggcctgaatctgtcctgaatgtctaaaccacctaagttctgtataattttgtggtttggtcaagtaatgtaccatatttgctgttggttatggtcagcacctggagctgctgagaacggtttgggtgctagaaatgaacagaagcacaagtcaccatactccagtgacataactcaaggaagatttgggtaaagggaaaattcatacttccttggtctccagggacagacagtccacagactttgaggatgacatgttcgtcttttcaaatatgttttacctagatcatttccttgtgttgttggcaattctcctgttacgtatttctagatagttatttaatggcatttcttagacaatgggaagaattgtgcagagcatggcatttgcagtcagagcttggtttcaagccttgtcctgtgatgtaagagctttgagaccttggagaggtcatgtaacttctctgaatctgttttctcctctgtaaaataggaacaatatttacattgtggagctctgagaatcaaataatgtcatgcataatacattcttcaacactatactaattactaagcacctaatatattgttattttgtttgttttttaaactgcatattttgtcagtgtggcatctcttgtctgtgaaatattcctttaacacatgtggtgtattttctcacctacgtatgtttcctcttcctaagtagtttaaaacacacacacgcgcgcgcgcgcgtgtgcacatgcttattcattgactaagttatccatgaacctgtcatttctgtcttctggagcaacatggaatctcatatttctatcttaatcacatatgtttaattttgcctttgttttgtggtctgtgggtacatttgttatttttagtatcaagtcatttggctaaatcatattaaattgcaatcacctaaaatcccctggttattttgacttaaatgactgtcatctttggtttcccttacttagaacgtcacacagttaattttttttttcaacctaatggcaagtgtgtgtgtgtgttcttggagtagttctgctggctatgaagagtatgtagtaatatgctaaagctttgtaaactcttcttttgttgttttggaagatggagtgttgctctgttgcccaggctggagtgcagtgatgtgattttggctcactagagtctccaccttctgggctcaagcagtcctctcacctcagcctccctggtttgtggaactacaggggcatgccagcatgcccggataatttttgtattttttttcttttgtagatacagagtctcactatgttgcccaggctagtctcaaactcctgagctcaagcagtcctcctgcctcagcttcctgaagtgttgggattacaggcatgagccattgcacctggccctaaattttaacagatacaaaactataagtttatacttaaaaaaaaaaaaaaaggaaaatactggatggaattatttacttgagatgagacatgcacagtaagaagttgagagagtagcagtgcatcaaataatgaggcagtgtcctagaggtaaagagtacaggcttagagtcagacagcgcgggttcaaatcctgcttctgccagctgttggctgtgtttgaccttagtcatgttacttggattttcattcagggaataataataattacttcatacagttaattgtgaggatcaaataagataatacaagtatactactataccatagtaaatattcaacgatgctacctattttggtgaagtagcttcaaactcgatagcagtttgtaaagcaatttattccatgaatattaagtacttgtgcatcaggcattctaataagggcctaggatttttttacaatgagaaatacttcctttctgtctttcaaagagcttaaaatatggtagggaaaaggcataaataagatagttatgatatacatgattaatggtagagttatatgcaactgttcttcagtattacaggggattggttctagaaacccagtggagacccaagtccaccaatgctcaagtcccttatatgaaatggcatagtaattgcatataatgcgcatcctcccatatactttaaatcatctctagattacttacaatacctaatacattgcaaatgctatgcacatagttgttatattgtactgcttttttatttgtattacttttattgttgtttttttcttttaagtttccaatttgagattggctgaatctgcgaatacagaaccacagatacggagagggccagctgtataggcgtttagaagacagaagaggggaatttaatcttgggaggaagagtcaatgtgagctaggtcttaaagatgagtgggagttacccaaaaggacaagatatatggcttattgcatatatgacaagcaaaagaacttaggtaagagctggtatgtagtaagtgaggaaccatgtgcatttatagttcccgggcaaacagaaaaggtcaagaaatgaacctggagacagaggtatgggctagatcataaggcaccttgtattacgtttgagaaagcacagacttcgtcttggagggagcgaagactattgaaggattttaatcaaggaagttatctggaaataaggagacttattttggataatccaggtgagaggtgataaagacctaaaatagaagtagtagtgattagcaaagtgataagaggagagacttgaggatattggagaggcacagatatcttattgatgatttgacaagaatacagaagtataaggaggatgttcagtggattgacatcttacacatggggcattttgggggcggggaataaaagtggatgtgtttaattttctgagtagtcacttagcaggcggcatgatttttaaggtgaaagctttgagaggtgaaggctggaaagatgtgggaaacccgtagggataactgataccaccaaagatactataaagcagcagttcttaatcctagttgaacatcagaattatctggaaaatttttaagaaaaaaaatttgttttttgagacaaggtctcactctattgtccaggctggagcatagtggtgcgatcatagttcactgcagccttgatctcctgggctcaagaaatcctcctgcctcagcctcccgagtagctgacactacaggtgtgcaccacgatgcccagctaatttttgatctttttgtagagacaaggtcttgtcttgttgcccaggctggtctctaactcctgggcttgagtgatcctcctgccttggcctcctaaagttctgggatcacaagtgtgagccaccgcgcctggcctaagagaagtattgatggtcataccacacctctaaaatttctgatctgatgggtctggagtggtacctggttatcttggatgtttttaaatatttttttaaattttttattatggtaaaatatccatacaatttgccattgtaactattttaagtacacatttcaggaatgttaaatacatgaacagtattgtgcaaccatcaccattattcatttctagaactttttcatcatcccaaatagaaaccattaataactccattccctcccactccccagcccctgataatctatgttcctctttctgtctcataaatttgaccagtctaagtacctcatattagtgaaatcattctttcatttagggtattctcaaggttcatccatgttttaacatgtatcagtacgatactcctctttaaggctgaataatattctattatatgtgtgtgcaccttttgtttattcatatgttgatggacatttgggttgttttcacctttagcaaagcctattcacctattatgctgcttagagcatggatgtacatatgtctgagtcgcacataaagttcacatcttttgggtgtggaggtagaattgatggattgtatggcaatggaaaatgaaaatcagatggtttttatctatgcagccatggttgggaacctatggtatagaacaggggttcttaatctggaggatccataaatggtcttagtgagttagtgacattttggaaaagttgtatgtcatattctgtatgtgtgtgcttttactttttggccttggtcaggtactcagagaggttcataaccccaaaagctgttaagaatcactgaccagagaacctaattttagggacaggcaaaggatttgagtaggcacctctccaaagaagatatgcaaatagccaaataaacacaagtaaagatgctcaatattgttattagggaagggcaaatcaaacccacaatgagatatactgcttaatatccagtaggatggctataacttaaaaagaaaacaaaaataacaaggtttggggaagatttgaaaaaaaaagtggaatccttgtttattactggtaggaatgtaaaatggtgtagcaagtttgggaagtagtttcgcatttcttcaaaaagttaaacatagagttaccatatgactcaccgattccattcctagctatatatccaagagaatggaaagcatacatctgtgtaaaaacttgtacacaaatgtccatgatagcattattcataatagccaaaaagtagaaacaacccaaatgtccattcactgagtaatgggtaaacaaaatttggtatagctatacaatggaatatttggccataaaaagaaatgaagtactgatacatgcagcagtgttgctgagccttgaaaacattatgctaattgaaacaagtgagacatagaaggtcacatattatttgattctgtttatatgaaatgttcatattaggtaaatccatagagatagagagtagatcagtggctgtgaggggctgggagaggagagaatggggattaattgtatgagtttggggtttcctcttggggtgatgacaatgctttggaattacatatggtgatggtttcacaaccctgtatatacactaaaactactttttaatgtatatattaaattgctgcattttacgacatgtgacctcagtaaagctgttaaaaataatttttaaaatagagatgaatgaggagagaagtagccagatggaaacctggataacttcaaaaaggaagaagatcccataaaagagattgaaaaagaataattatgtaagaggaggacctatagattgttgtgtcatgaaagccacaaaatggagaggttaaaggaggaaccacggaaggggtgtgatttttaactgtggtaaacacagcagaaagtttggtaacaacatacagtatgcccaaattgctgtaggttggcatttgaatgtcatggaagactagggagggcagatttaatggggtaatatgggaagagatacaatatctttgggtcatagagtgagtggaagggaataggagaataatctacatgcctgtattcccttatttgagtctcaaaattcagcacactgaaaatggaaaggtgttttgtaattcatttggcagtaaaacctgacctgaatggatgtgagatgatttataatcatttgtttcatttagtgtgaatattcatacatttcactgcagaaataatactgaatttgattatagaatgcttctgtagacccttctggggttataatgaaatatggtatatgacacgtattatctttttttttttaaacggagtctcactctgtcacccaggctggagtgtagtggtgcgatctcagctcactgcaacctccgcctcctgggttcaagcgattctcctgcctcagcctcctgagtagctgggagtacaggcggacaccaccatgcccagctaatttttgtatttttagtagagatgggatttcaccatgttggccaggatggtcttgatctcttgaccttgtgatctgcccgccttggcctcccaaagtgctgggattacaggcatgagctaccgcgcctggccgacatgtattatctttctagaatgaaatatatatatatgtatatctacgcacgtgtgtgtgtgtgtgtgtgtgtgtgtgtgtgtgtgtgtaaattctaaatcatatggtccccagtgtttggggataaaggaatcccagacctttgtattctttagacaggtctggatgtgaaggaagatttgagattgaatggtagttggagaggaatttaagctcatccttgaaacatttttattttaaaggatggaaatgacctgagtatgcattaagtagagaggaagaggttgaaatattgcagcagggtctcccaaggtgaggaggggaatagaaatggggttggagtagttagtgtttacaggcagaaggatcacacattctctgagacaccagaagtgatgttgaagatggagttggctatctttctaagcaggaagaagggaagttgaggaaaatcaaattgaacgggtatttactgaagtggcaaaagctggaaataattgttgaggtcaatagaacaagctgagaacaaagtaaaggattgacaggcaggactaagggcctgggcaattttagaaaccctgaaatctatggggcccctctgccccttgttgcttgatattctccatcagtgctcagcttccccttatggtggaaagacttgggaatgaagttttgcagaaagaattctatgagagggtggtgtgaaagagaactgaggtggctgcaggtggggaggtggctctagcttgagaatgacggaaaggggcaggggctggcatacactgaagactgttggggaggaagacagtatgaaagctagtgtgctaggagtttgtggaccaaaaaaatggtgttcaaatggaaacagtactgcgtaataacaaggttcagggcatgattatagaaggcagcggccgaagtggaggggaggtgaacttcgttggagttgacagacaaggacctgcgggatactcattagttcatccacacagtctttgaaattactcagaatgatgaccagatttgagctagagaggaagcgctagtctgatggcagaatgcttcagtaactgtgggggattaagctgcatgttggtgaacttaggaagatagatagaggcgttctatggtactggtagagagagggttttttcagaggaggaaagattctatataagggcatctttgtaatggagtgaggagagggtgaccccacctactatccccactacacgtgtaatgagaggacagcagcttctactggagtggactgcagggaagtggtggcctgtcaggagaaccagacaggattaatatcctattaacacccagcaggttattccaccagccttaactcagttttccattgtcatctagcccagtaggtttcagctgatctcctagggtctttcctcaagggattctgctttagttggtctggggcggagccaggaaaactatggtttcaaaagctccttgggtgattgattagtggccaaagatgaagaccaccagtggaacccacattttgctttcatctgcacaacagcattacatcacatgcctagctgacctcaacatattgcacctatggcatacctgactcggcattctttcatcagagtagaaatgaagtgcgaaaacaattcaaagatattcaattactaggaatcagtttaaattgtgaaacagtgtcacaccataatctttaaattagcaaagcatttttaaaacatcttaatactcgttgtgaattgtgagaagggaactcgcatactctgctaaggggattgtaaattaatacagtcttcttggaaaacagtttgacagtacataaataggattaaatatggtcagaccctttgatctaataattacatttctaagactattgtaggtatataatcagaaatgtggatcaagacatatttaagatattaatcagtgttacttatagtcacaaaaatggaaacaaatggttaaatatggtatattcatatgatgggatatcacagagccattgaaaattataaagacatttaatgacatggtggataacattaagaaaacaaagacccagctataaaattatatatacactttgtgcttgattgtatacacacttacattttaaaatactgagcaggaaattttttaagttattgattgttctctgggtggtaggaatatgtgctattctattcttttgtgtttttgtatttttctaaattgtatactaggagcatgtttattaagcaaaaagtaagctttaaaaaattaaaattcttactctaatctctttagcaaaaagaataaggaaaactcatttgggatgaatgttgctagagaagtccttgctcatagtaatccccagtgtgttttctaaatacttgcaaactatctatttatctgttgcacagtgttgccaggttaagcctgttggttttgttctttttgtttcatatgatagctttcttgaggtataattcacataaaattcagcctttttaaagtgtacaattcaggagtattcagtttatttgcaagttgtgcagccatcaccatgatctaatttcagaacagttttatcaaccccaaaagaaaccctgtactcaacagttactccccatttccccttccctccagcccttggcagccaccaatctcctttctgtttctacggatctgcttattttggacatttcatataaatgcagccatacaatatgtggccttttgcagtatcctattaatgagtctccagtatctcctccctacactgctggaaacgtcatttagaccgctaccatgctaatctttctagcgtaactgtgactttaccatcttcagctcaaaagttttcattgtactcacagtttattaaattgacaagagctattccttattctgggggttaaggttttcagactctacaaagtaagtgcctaactaaatacctggtaaataaatgaactaaatgaattaaatatactctaccttatctcttcttttccttctccctcagagaggaagataacactatgtgttagtcagatttcaggtcacccatagagcaagacaatttctttctaaagtttagggcagcggttcttacatctcagcaagcatcagaatcatggggaaggcttggcaagctgatgctgtgcttcacctccgaagtctcctttcagcaggtctggtcagagccagagagtgcatttctgacagttctcaggtgaccctttgataagcatggttctggggtcgtgctggctcaggtaggatgcagtcagcactcagtccagggcctggcagtaacctgggggaaagaggaaagtgaggaggggaaggacccacactcccaaatccccggatcccatggtcatcccagcatgcaggctccccacaacaactctagcattgtctcactctttagtaactgtaccactttggtgccctgaagttctcttatacatgctcacccatctccccttcactttggaaaattatacccattcttcaaaacctagctcaggcattcataaaacctttgcctactcttccaaatgaaggaagtaatttttccttcgttagcactttgtattttttatgtatattgtcttgtatgttaattaattccatacttgtatcttcttcctaagtcttgcatttcatgagatcaaattctgttatttactcagtgactgtattgcagtgtccatagagcaaagcattttgcccttagcagctactcaataattatcagtacagttgaattc

SEQ ID NO: 33 - DNA, 3123 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgcaa

SEQ ID NO: 34 - DNA, 2606 bp, Homo sapiens
cgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgtggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgaaaaaaaaaaaaaaaaaaaaa

SEQ ID NO: 35 - DNA, 131274 bp, Homo sapiens
aattcaatatagcattttataactttttccttttacccctaccctacctactattattttttcctattataaaagtcatgcttattgtagataattaactatatatgaaagtaaaaagaaaaaattaaaatcatccaaagtcttattatccagatataatcactcttaattctttgttttgttctttgttttttcttattcacataatttcatactgtccatgtaattggtagtctacatgtttatataatattttagcatcataatactataaatttgcatttttccgtaaaatttaaaatattctttaaagtaccttgttaaattttgccaaatattcctttatatagatgtgctatgctttatttaattatttttctattagatatttaggttgcttatagttttttactgtcataaaaattatcttttttacataaatttctgttggttttctattacatttgattcctgggactaaaattactgagtaaaaatattgaactttgggttcttgatacatagtactcagtgggtttctagaaagtcttttgtaatccacattcccatcagaatatacgaagatgttgttttattgagccatcatcaaaattattacctctatatacttttaagcagtattataaagtggacttactgactataatgtgttgctgtaatcgactgtgctcagaagaactatataaattaaacatgtccgtttgctttcaaaaagaattttttttttttttgagatggagcctctctcttgtcacccaggctggagtgcaatagcgtaatctcgggctagtctcgaactcctgacctcaggtgatcagcccacctcagcctcccatagtgctgggattacaggcgtgagccaccactcctggctagaactaggaaatatttttaagagtaccagtagttcccaggctgtatgttgcaatacagtttccacctaaatccaaatgtttttcaggtctaattgtaaactgctacttttgtttaatgtggacttacatagtcttctgtatcaatacctacttcgctggcagttttgtcaaagtgtgttgagttgaggcattttgcattatatccgacgtggtgttagcattccttcttgtagcaatcaatttcatttctatttgctgttgtaactcaaagttaacgaacattcaaagtttactttcatttattcatgcatttttttgtggactgctctacaaaagcacctttcttccttaacaacattctatccaaactgagtgcagatgaatctgagtagtttcattttagagagcagcagtcatatttgtattaggaaggcaatagtcttggaagaataccaaaaaaaaaaatcattttaaagtgtttgcctcgtcctctagtgaaagcatttgagtttcagaggccatggtgagtcagagtcccttgctagtgcttatgatacactgctaagggactctgtgtgtgtgtgtgtgtgtgtgtgtgtgtgtgtgtgtatatattttcagatatatgaaatatcctatagggaaaatattgataaaaaataatttacctctttatgcactgaaacttttcctacttctctgcaggaattgttgcaacataaatactggttccaacttagtaaattaatttttacttatatatttcttttacatttcagaattgatgaattgcaagtttgtgccccatagctgcacaggtatgtatatgaattacctataactatgtaaatctatatattaactaacaagttataatatttttatgtattaaaattgcttatagatttcataatgtaaaaatgttaattcttgattacttacagataatgacagcttcaaaggatagtacattttatacatatattttattttattctattgtaagaatcaagtaaacatttctaagatttgataaggcaaataattttaattacaaagcattcatctggtgaagagattattttatggaattgtactattaaagtgaacggtgatgtggggtcagaccattgcaaaaccacagttttgccattattgttttatttaaacttttttttattttgctgcttttgagtttattttctgtgatggttgctttaggtatggagtggttgcagatgtactgtctgctccactgtctcaagcactagacgaatgggaaaaaaaaatgtttgcacctgtttaaaatctcaaccatgcagtgttgtggttcctgggcaacaggcaggaattctcaaaagcttggttgcacctgctcaattgttgcttgcagctgtgtcatatgagtgagagcacagagaagcttgttagcagtgtgcttgtgctcttacgtgttttgtgtactctgactctgaaagattcttacttgatgtagaccttgaactgttacattggtttattctaaaactcactggttttagcttctgaatattttctttaaatcctctgttttatgactcaaatattttttttttagtagctgttgactgccctagataatgtgtatgccaacttctcgaaagaatatctgggagagtagatctcttcagataactgggttgataataatttttgtcctggtagagacattttgtgtttggctcaatttcaccgtgttggcagccccactatgtgaggctggatgtagttattgatccatttagctgaacagatttgaaagcatttggctattagtggacacatggggcatattcagaaaatttaagggtatattgtaagataattccttaatttgtgcatgtgtttctgttgctgttggggtagaagtgagagagaaaaaaagtgaagattaaatagtaattctaaaagaggggctaaaatccagatgtagattttatggaatattattctttaatttaacaaatgctagatgcttggtattttttcacaaatgttactggtaatgatattaaatgtattttagttgtggctttgtatgttttctgacagatatctatatttttgatatagacaagctattatagattgtatattttactaataggtaaagttctataaatgcaataaaaagctgcaactcaatattaaagatatttaattaatttattcagtaggctcaaatttctcatattgaaaacatccaaatgacttgcattactctccttaatgtattcttttaaatgctgaggagtttccgtcggtatttagtaacataaatctggtcttagagttggtgtgtcttttccttttattggcccatttggaatccttttttgtatttttaacaaatcactttggtattaatttaacctctttggaagtaggaaacacagtacaaaggtaagtagaggattgccacagcctcttatacaatgccttgtacatagtagttgatcagtaaatgttgaatgaatgcatttatgaataaaacatttctggagttgtattagaaatagagggattgtgtcctaaaatcttattacttgttatacagtttagataagtcttgatggcctttagttctcatactgccagttacatagatatgagaatactgataaattctgtccttaaaatgagaaattaatgtataagaactgatcctttttgactattttaatgaataattgaaataacactatttgcaatgtgctttaaactaacttttacttattacaagaagtctgtatgttattcccattatacacataaggctgaggcattaatggctaagttacttgtcaccttggaaatactttgcagcccataaataaacaaatctatgttatatggttaatgcctcgtctttcctgagcactggcttatgcttctccctccctatctctatctcactaaaacacaaaaataaaatgtgtgtttaattcctttgggtcagttaagatcagaatattaaaaaatctgtaattatttttctaagcaaaagtaatggaccctgtgtttactgtatacatgtttataattatggtctctatgactcactaaattttaattataaatagaggtaaagccaagcaagagtagagtcaaaatagaacagttaagacttgctttagatagatcattctaatgttccgttttgtgtggcataagcccgtcacataagattggcacagtttacataataagccagttatctattgcattaaaaccttttgtttaggcttctcaaattttagtaccactggtttatgacacatgtacttttaggcatggaactacctttcctctgggaacagtttttcttttacctcagttcacaccagtgtgcaagaggccaatatcaaagacatcggttttttccagtgaatcttagtgtggtagattgaactctatctctctgttagtctcaatattagaaattaggagatgagccaagaatatatatttgctagaatattaatcattaaactagacagatattagcagctttttgagggtcctgtgtcaggaattagcctggaatctcaaagagggaggaattcctatgccctaggattcctgagcattattgcaggttcccctgcgatttcagggttaaggaaataaagaaagaaaatccacatttattaagaacatagcatgactagatataatttcttttttcccccttctttccctctctcctttcctcatttccttttattctgcatggtgaatggatgtctgctgtttgctagaaattgtgctaggctagatgaatacaacaaaatctttgttctcaagaggatacaggctagtgagagacaaagatatatcaatagagttctttttgacttcaccacttattattagtatggtctcaatcaagttacctaatgtttctgttcccttgtttactcatttgtaaaactgggaaaataatagtatctgttgtctgagagttaataacacactacatgtaagattcttggtccactggttggcacatagcaagtactgaagaaatcttagctatgctactgtcatttctatcactaccagttccctcgccatcaccactactgcagtttagactctgaaaaaagaacatctaattgcctgggagcagggatcctggttgggcattatcacatagattgtactcagaggttctatacaaagttacctctgcttccctggccttagaagatattataaaaatcatgaagcaatgtactgaatctaaaagaccttcatgtgatatttttattattttccccaaatttttgtatttgggaaaaatacacacaacatgaagtttactatcttaactattttttggtatacagttcaatggtattaaatacatttatgatgcttgcacagccatcaccacaatacatctctatataacactttcatgttgtaaaactaaaatactatacccattaaaatataacttcccatttccctctgcactcccacccccagcctctggcagccaccattttagtgtctgtctctgtcattttgacttctctatgtagttatataagtggaatcatatagtatttctcttctcgtgtttggcttatttcacttagcgtaatgtcctcagcattcatccatgtggtagtacatgtcaggatttccttgtttttatggctgaataataattaattgcatgtatataccacattttgcctgtccattcactcatcagtggacacttggattgcttccatgttttaattattatgaacaatttggctatgaatataggtgtacaactatctctctgagaacctgctttcaatgcttttgagtatatacccagaagtggaattgctagattgtatggtaattccattttcatgtgttcttataataagattaatttcatttaaattgaataaagccttttaggttgtgtttgtgaatagcattgatttcctcataaggagaataagttgagttaggtttagcaagaacacatctactgcttatgtgagttcaaatgctttcaacacgcctgtgaattccttaaataaatcaccatcttggaacccagtgatgcacttaggatatctggattgtaaatctcatgcttgagtttgaatttaggagctttggattccctcccactgacctttaccaaaagtctagctccattattcagtagctgtgcgacctcatcgaggttggcagagcttactaagcctcaagctttcctatgtatagtatggtggtaacaacacctacctttttaatggtggatatgtggattaaagtaaattaggtatacaaaatactttattttgtgcaccactaccacctatgtattattgcatagtagtctctgtgtattattttttcctctcttctcttgacaaaatataaaaatttttataatcagtagtataggaatttcaaggaagtgtgggacacatacattaagaaagttaactttggtccaattatggctcttgtgatatctgttgcttatctcagttcaacataattagactcataatttctaactatacatgccacatttctatagaaggctagggctgtttaaagaaaaacttaagatggggatgctcacattcacttcaatgtctgttgattatggaggtatgtcttgcaatagaaagcgtgttgacacaacccagacaactctcatccctcttctgaaagtcagatacctttaaaagcagtctcttgcaaaggatgaagaacccatgcttgatgagttactttcatatgcatcaaaatgacttaaaagtggtcctgttggtaatctaagcagcctcaggtttagtgagcatagttgtcagtgcataaatcgctgtgtaaggttttattttttcttgagaaggaaattagtgtggtaagattttctgatttccttctatgcaaactcaacagtagaaaagtggatttatgaatttatatgtatgattttcccttaattatctttaataataactagatgatcttaattatagtaaaccattttcctctgccaggctgtttatattgcagcagtatcttcttgtacagcaatcagaaaaggattcttttaaaataatgaaaacatcactagataatatatatagaattgattattactcaccagaggtaatacagacctgcctaatatcaaatgtatagtttcgaccatgatgaatcaaggtaaatattgatgattaatggaatttttatttagttgggaatattacaaaggaccacaaacttggtggcttaaacagacatttgttttctcacagttcagaagtctgaaatcaaggtttattagccaggttggttcttctcagggctgtgagggaaggatctgttccagcctttctccttgacatatagatggccatctccttcctatgtctctccatatgtcttcctctgtcttccctctgtaagtatctgtctctgtccccagatttctctgcttttataaggacatcagtcatattgaattcaggcccaccctaattgcattattttaactcgattacctctttagagacctatgtccaagtaagatcacatttggaagtacttggggttagaactccaacacatgtttttttttggaggggttggggaacaaaatttagttcatcataactgggttaatgatagttaacatttattgagtgactttcatgttccagatgctatatatatacatatgcacatttatgtgagtgtatatgtatatatatgcatgtatgtatatatagatatgtaatatccaatatatgtatgcatatatgttttatgatccttgcaacagccctgtgaggaagatgttatttctcccattttgcaggtgagaaaacaaaatgtcagagaggataagcaatttgtccaaagtcatatagcttgtaaatattcaatgctggtatttgaacctagcatcccgtgctgcttttaaatggataaacctgataaaaactcagtcaaaagcccaaagatactttgaacatttaaggtttttgtgttttgttgttgttgttgttgttgtcattaggacttgtgtcaagggacattttatctatcaaaaatggtgcataaatgcctaatcactgactgccgacgtgtttactcctgaattttttactgacaattgtcttcgaaggcttagtgttttagcgctcctgaacctgataaagcttttggacaggatggaatctgaacatagactgcaagcgttgattctggcccccatttgtatggatggcactgagagacaagtcatgcccagagtctgctactcagcacttgtgctttctactctccttttctctcactccctccccttcctcatcttttttttttcactatttaccaggtagcttgtgatttttttcttttatccagtctttgccataagtgataaacatcaaaaggggatggagtgaagagtcacaaaattgggaacatttctgcttacatgaaagccagttcacttgtaggtgtgttgtgtaccctggccacaggcttattgttattcacactaaagagcaaggcacattgtgtaccttacataagttttccaacttaccaatgaaaacagtttgtttctcactttgaagctttaaagcagaacttgttcatgacccaatttcactaataattctcttaagtaacccttgtactcatttaaagatttttttccacccactgtctgtctagcctggtttaaaatttttatatatgtacttttaaaaaattgattagctggagagctgcccattcctctgtgctgtataataaggattttaaaactgcacactgaattctgtatagtgtaattaaaactgacccacatttggacctgagtacaccaggacttagccaaacttgccatgagctgagttctggtggcagatgggaactaatgaggacacactccactccagaatttcccagctgcttggcccctttttgtacaaacaaggtttggagcgaagtccggatcccaagagcatgttctgtaaatgtgctgtacccaatgatttgggaaatgttctcacaaaattgggctgtttcaaggtatccataaggcctcagtgactttcagatttaaattcaaagaggcctttgtgctttctacaaccaatttttaattttaaagtgaataaaacatcgcattcccccatcttttctcttatgcctggtgatggaatgatcactttatatcacaacctggaaatttgcaggtcattatctcagagacagttgtccatcaggatagacaaagtctccttgcaacctatggatctcttcaactagtttgatgtcctgggactattcaggcagatgtaattgaatcagtttgaagcagctgtagctggcatgtggtctctcagattgctagcacctgcttgtttttttgcaactcactagagtgagagaagtgccaaaaccagcattggtcttggagcagataaagcactccagatcttatatcccattccccttccaacctagccacatcatcactggtgccgaaattaataaaatcccttttcatgattaggtctgaggtatacttttacttctcattcttctctgtattcagatcctgacagtactgaccatgcaaatccaaaaaaataagggagtataatggtgatcaggtggctttggggctctcttatcattagacaactgggtagcctgtggtttgcagaatcatttaaatgaatgcaccaaatttatttgctgttccagcacagtcttattggcacagagaataagcagttaatgtataacaaactgtgagctgttatggaatatgatgaatacacttccttagcaagacggaatgtaaaatggagctatctctctaaaataaggtctaaactaaccactgtggatttcttcaacacttactatgtgcaggaaaatgaagtatactaaaagagagatacaaattttaggacataataagtatgtaaaatatattttgaaatacacagatttggatattttttttttttggagatggagtctcgctctgtcgcccaggctggagtgcagaggcgcgatcacggctcactgcaacctccacttcctgggttcaaacaattctcctgcctcagccttccgagtagctgggactacaggtgcccgccaccacacccgtctagttttttgtattttagtagagacggggtttcaccatgttgcccgggctggtctcaaactcctgagctcaggcaatccacctgcctgggcctcccaaagtgctaggattacaggcatgagccaccacgcctggctggatttttaaaaaatgtttaaactcatttaagaagtagttatcttctctttgtttcattttattatttggcaggtatatatttaatcgttaagtgttatcaatatcctaatgttgaatttgaatctggtcatggtaaagacaatatatttacttacattttatagcttatgttacaaagtttttctaaaatgggttcaatattgataatattttgagagaagctatgacataaatggagttcacaatagtaataagagtgaattctaaaatggtaatttattgtcatcagcaaatgcctatgtttcaaggcatgactacatgctgtgagcatagagaagtattacatgcaagaatcttatgatacttgaggagacatgatacaggttttttaaaaaataaaacaaggcactctcagtgtcaaattgcatgcttagacctggatttggtgtaaaataaatgctacaaacattttttttaagttaggcagtctatttgtgaagtcaatgttctaaattcagcatcccctgtctccccttcactgtccatgaaacaacactaatccattatggctgtctctgtcactacaccaaaacttgacctcagagtccctctgaagacagtactttgacagccataccaattgttggaagtttcatgtaataggaaacccatttgccattgttgaaaaagaatcattaagtgctaaagatatttagtggaggcagagatctctgtgaactgctgggaagaggctgaacttaagctgggccttgaaaaaaacatgaagcataggacataaggaaatagaaaggagaacatcaagcatcgccaagctaagtaatgcatacaagtgagttcagattggaattatgtggcatagtcaaagataacgaatagacctcaggtgtaaataaataagtggttatataattattagtttaatgtttttctcctccgccagactgtaaactctgtgaaatgtgataatattattattatttttcttccttttttattatactttaagttctagggtacatgtgcacaatgtgcaggtttgttacatatgtatacatgtgccatgttggtgtgctgcaccccttaacttgtcatttacattaggtacatctcctaatgcaatccctcccccgtctccccaccccaggacaggcccggtgtgtgatgttccccaccctgtgtccaagtgttctcattgttcaattcccacctatgagtgagaacatgcggtatttggttttctgtccttgtgacagtttgctcagaatgatggtttctagcttcatccatgtccctacgctactcagaccatcctatccgagttagatctcccatgtgtttctgtaggttcttattgttttcattcacatacacaatttacttcacagtttacggtgcagattatcactgccaagattctgtatgaggaatataggggaactcaaagaagattttgttctttttaaatttatttaagaacaataattttttaagaagctgatttttatttttataaatactgtggtgctttcaacactggcttggaggaatttctattttaactgcagtatttaagaattttactgttaatacatatctctggtttcagggaataaagagacaatataatagagtagaaagagtacagggtttagaaatagaagagagggatttaagtttctctgttatcacttattggctatgagatataggcagctcttcgtgtgcttttacgctcagtttcctcatctgtaaattagagatgacaacataccaaagcactttaaaattaaaaacatctcttcttcttcctcctctcattagtcatcataatcataatgctattctgaaaccatgtaataaaatatggtcttctgtatagatccttttttttctaccacttattatttgctctagttattgcagatttactctacaccttgagtagagcattatactaatctaaaaagaagcaagaattccagaaacaccctataacctagtcatggctaatatttactgttgagttatttgcacctcaataacagttctctgtcatttgtaatataactgcttaatattaataatttatgtattaaaagtaaatgttttataccaatcccaaacagtgcctttttatgatttattttttattcactcattcatttaatgcaaattattgtagctactgacacaaatgtattcactttctacctgattatataggaataccctaattatctatattcacatcttattgaacttataaagtgttaggagaccagtgtctgagaaaaaaagtcaaatataaatagattcatctctgagttgtaagaaccttttgttcccacctttagaatatttggtgactaattaattactaatagtaattaatgcacaactcttaagttaaaaaaccaaaagaaaaagaatttgatatttgcagttttctaggaagttaacgttttcattctttcctgctttaaacatgtaatatctaatagttaatatctgcatgtatcatccttatggttttgagagtctttaagggaaattatgaatacaatttctatttttctaaacgaaaggatttctgtgcattagggtaaaaatgtgtgaatagatatttcacacattcatatttgtgtaaaatatattttcaaaatatatttcttaagctatttaaaaatatatttttaaaagtatttaaactttttacactacatttcattgttatattttgttaagcatatcaaaagaagattataccacaggttatgactttttaaaggtaaaaaaattaaataaggtaggactatctgaaagttaagatttaagtgtaagtacataaaaatatgcacagaaagtaaatagagatattgaaaattaactaaaatgttgcttctataatggcttaaatttgtgtagcaaataggatagctgagtttagtattacttaagaaatggttaattttgtatatcaggagacaattcaaacataatctttaatcatgctgatctgatgcctcaagccgtgatctgtatacttattagggtctttgccaagtctcatgatagtatatactctagaccaaaataaaattgattttcctctatgtaaatttgttactgatattatatttaaatttccattgatgaaaaataggtatatttactctctgaatcaagttcttcaggaacataaataattttttatttgagaactgatttatgtccaattaagtaatttccagtatacttttgctattgatcatatatcattgtaagatattaattatttacatcaatataccacttggatttttaaaaatataaaggcctcactttgtcacccaggctggagtgcagtggcatgatcatggctcactgcagtctcaacctcccaggcagtcctcccatctcagcttcccagtagctgggactacaggtgtgcaccaccatgctcagcagatgtttaaattttttttttgtagaaatgggggtctcactatgttgcccatgctggtctcaaactcctgggctccagcagtcctcctgcctcagcctcccaaagtgctggatttacaggcgtgagccactgcacccagcctattaattttcttttctttctttctttctttttttttttttaatgaccaattccacgttaagatcagtttctggcttgcttgaaaggattggatcagaagatgttgcatcacttttggagggcatctgcatttgatttaagagggaacagctccaaatagagggcagtacatttcgtttgaggcttactactaccagaaaccatcactgcaacctcttaagttttctcattgatttttatttgtccttatgtgctcctatcaattgggggctttgagatcactatttacacttataaaacttctgtatgtcttcctctgttttagtcctagagagtacagggaaagtgtactagttacctatggctgctgtagtaaattatgataaactgggtgacttaaaaacgacagaaatttattctctcacagttctggaggctagaaatcagaaatcaaaatgcagcagggccacattccctctgaaggctcacagtgaaaatctttccctggctcttccagcttctgatggtcccatttattctttggcttttggcactatgacgtcaaactctgccttcatctttacagcaccttcccctctgtatgtgtccctctgtgtcctctcctcctattaaaagcatatcagttattggatttagggcccaccttaaatccaggatgattttatctcatggttcttaattagttgcatctgcaaggaccgtatctcccaggaatgttacattctgaggttccaggtgaacatgaaattttggggactctagtcaacattcaacctactatagagagtaatgttattttttggtagtaaatatctatggaagacttatttacacactgctatggtttgaatttttgtcccctccaaaactcatgttgaaagttaagccccagtgtggcagtattgagagctggggcctttaagaggtgggtcatgagggcccatgaatggatgagtcttttcttgggttaatgaattactgggttatcatgggaatgggactggtagctttatagaaacataaagagagacctgcgctagcacagtctgcccccttgccatgtgatgtcctacgttgtctcaggattctagagtgttgtcacggcaagaaggctttcaccagttttgctccctcaaccttggacttcccagcctccaactataagagataaatttcctttcttataaattgctgagttacaagtattccgttataggcgacaggaaacagactaagacatatgctaacatgttaattatttttcccctcggtatttgacaaagtttatcctgtcctctgtttttagaatacttgtagccttagcaccttggtattttttatgaatttcatggaattatgaatcattttctgtcatacttttttaaactactgaaacttctcattatagatgacaaggttgaggcatagaataggtaaccaacagtcactaactctgcagatggactgcagaactaaaaactgacattggtatcatccaacttttctgtcaatccatgtgtgttgagatgccaaatatactcttatagtccatggtactttcacataactttacttgtgacctaagtaaatcaagagttgcagaaaatgtttttcgtaatgatctccagataatataagccaagtatacaattgaaatttagtgtcgtagatggacaaaagtattgtgctggatgactgcatgttgagatcacaatccgtctaatttctctgcttagcatcggccaggtctttattagagaactatggatatggccatacgtacaaatacacatccattaaatgaacactggaatcatgaatatccaggtctagattaaaagagcaagcccaaggctcagaaagttaatttctaactttaaatagctagtaaatggctgacacaggactaaactcagctctgctcaactcagacacctgtttttctatttctcccaagttgattctcaaactgcaggaaatctttgtgttttccccttttaagtaaggagcagaccactattagggtgagtgggtagagggagcagaaggtgaagtaaaccattcctaaaataattgggatataattggaagcatttgctgaccctttccacctcatggttgtaggatattacaagtatgttttctttaagaatgctcaataagccaacatagataaatttgaattttaaacatagataattaatagagtgattatattaattaatcagaaccagtattataggtctcatctactgaacatttcttttaactttcagctcttttggtgcacttctgttctggataaaatataattgtatgctcagaggacagaaaaattttacaaatgagcttaggcttccctgccagaaaagaaaggatgaaatagaaatgaaaatgaaaattaagtaatccctgaaatgataatatagttaaatgtgaaaatatgcctttgataataccaaactgggatttgcacccaaaacacattaattgaattaacctgttttagtttgtcttgtatctgttgccgaaaaaaaaaaaagaagaaactattattttgttagatagcagatttctttctggtgttgattactcttctatcatgagtaaataattacaattcagttgatctcaggcactagagacagagctctgaactagaagaccgagagagagacactaaacaaattaacatacaactacaacaaaaaggatgaagaatggctggtaatccggaggcagggtgtaggtgtcctttctgaggaaataaagtttgaattataagacttgaatgacgtgaaggagccattcaagggaagatcttgtgtacaagaaatgcaatctctaaatcattacaggttacacagagttgtgcatccaaggtttgtgtgtattagagtagctgtggcaagggaggagtgttctgtcaactattaacaatgtacagttgggaggtctgcttcttcaggggcaaccagtttatcctcctctttatcctggtactaaatatagccatagtaagcatttgggaatggattaaaaatgcttaaccaaatctccttaaactttgccatatcctataaattttaaccatatctcctgaaattttgttatttctgaaagcagaactaagtttggccacaaagggagggattgaattcattgctactcttagctctccctagcaatttcattgtctgctctggtaccagggtttgttagaggagctacaggggtttttgagccatcatttctccctttcgcaaatcacttcttcaagtagtagtatcagcccttttcctccttttctgtatatcaagactgaaactgaaaatgaagggttaaacttatttttttttattagtctcataggagcccaagatttaacatagaactttttcggaatatatagttatctctccatttgaggtgagcacaggatgtctatttttctcatttctactttcatcttgaaacagaaatttcaccaaaagcttcattcaaaatgttttattcatagctaagcaaagatgtatggtagtaaatcattgaaactgatgatctttgattgaattttccttagtttaatgtgtctaatcaactgttcattcaccacattattttcccattgctcgatgttataccagataacagtattaccatgacccaggctgatactatgtgaaaaaatgcacaaggaagtaggccgtctactgtgaacatttgaaaaacacagtcagatgacagtttcagaaattgtgaggtttttagatgtgagaatctaacttttttcactacagatactaaaaatctatcaatatactttttagtaggctttagccacatcctaatttacaaatgtacctatggtgtgtgattaagaacacaccggccgggcgcggtggctcacgcctgtaatcccagcactttgggaggccgaggcgggcggatcacgaggtcaggagatcgacaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcctgccactgcactccagcctgggcgacagagcgagactccgtctcaaaaaaaaaaaaaaaaaaaaaaaaaaagaacacaccattcttaccagttataccccttgaatcttaccaaggaaattcccatggttctgtccttatcacaatggaacccagaaatgaaggaatgaactacttgctttcttagaaataccacagtgcagactttgctgtatctaacagatatgaccatataatttgtcatctgaataacgatcgagagatttttgctttaaaaatatataaccaaatgataggaatattaagtcacaatggaagaaggccattattatactgaagcctcaagtaccacaaattaaaaacaagatggatattactattttaacttgtgagcatgcactatcaggttatccaatatcaaaaacatattaagagtgcttgtggcaatatatacctgaattataaatgaatgttgatattttgacattattttgtatatatgagagcattaatcaaggttagattcaacaagtcagcttcgtggttgtggctttaagttggcagtgaagtatgtaagtaatacatttctgatcagttttgtttgatagtcttgtttcaacaccttggcagaactaaaccattgagacccagaggtacttgtgcatggggatggtctttaagataatatttagtttattcaatgagccaaaattttcagtacatttattgtttgtttttgtcataaagacatggctacagtctacatacaaaataccaagtagagatttgtttattgtagtaggtacaggtgctcaaaattgatatttaagtctcaaacatatttttccaccattctgtattggattattaacacatgaaaatatgtactgttagaactataaggtaacttacagattattctttgagctaatttaattattattttacaaatgaggaaatgaaatcccagtgaagttgaatgatttactgtgggactagagaagtctagaatgagaaatttaacagtgcagtactctttacttccatgtatatacctttcaccatttaccattacactgaacaatctttctgctatttgtatttttaaaatgtgctcacagggttaaaaaatttgaatggtacacaaggatataaagtgaaaagtatgtctttaccgactgatagcactattcaccagagataaaaagtttcaactgtacttgcgtagagaaatgtgtctatatacctttaatttaaaaacagaaagggaatcatactgttcaaatacatttgtacttttttcttaatgccatgtcttagagattttatatattctagaaattttatagtgtttatattttggtatattatattttaccttttcctctttttaaacagctacttaatatttccattttatggatgtcacaaaatgtatttaaccactgcctatttatggaaatttggttatttacagtttcttcgctgtttaaaaatattacaaaacagctttctaaatatatccttgtttttattttaatatccacatagcatactttcttagatatgtttatataattaaaattttgatgcctgttaaaaattttccttcaaaaacatttttctgacacacacatgtaacaacattatatgagaattcctgctttctcacagcctcatcagtactgggctttagcaaatttttcctaatcagaaaagtgaaaatgatatttcaccattgttttgatttacatttctttactcaggagttagattaaacaacatattaaaatttcactggccatttacatttttgtttacttttttgtgaattggctataatacttttctgtatttttctattgagtttttaaaaatattttattggtttgtatagcctctttgtatattatggaaaataaattttctgtagtatgtgttagacatatttcttggttattaatttgctttttgagttttgtatatgtagaaaaattttttatgtagtttcattttttcaataatttcctttatggcttagaaaacttcttacaccagaaaaattactcagattttcttctagcacatttatgatttagtctcttaatatttacatctttgattcaaccaaaacttatttttgagaatgaaaataaagtttaattttatcacttgaaataaaagcaccaatttttttaattctttgaaatttcatgaattttagatttttctgaagctttatgaactttttaggaaggcagcgatcatcactaaggtaaaaagaaagcatattagaccaagaaatgtaattttaaaattgacatttcttattacttatcaatccctgatgtctattcttggtgacataggaaaatcccaagaaaacatcttctttataaaaatatataattatattttgctaatttaagcaatgattaaatcagtgaaaccatcatagaataaatcaaacccctagtgagatacttttaacagcaaatccagttcatatggtaatactaattttatttacttaacaaaagcacttacttatcagtaagaccctatatctgtacaaatgaaatcaaaatgtgaaagttgtaatttaagcgggacacaatagcttggtgataaatagatttatttgtaccttgaaaagttcacttcaagtaatcattgttattaaaaggcaattatttcacatggtttttgtaagcataaaaagcagattggagactctttctaagagttgtgctgactgacatctttgtaagatttgtaaataagtgaaagatccattcagctagaaaagttgaatattcagtaataaaagaacattgaccagtttaacatctattatatttacatctgtagttgacaaggagagaagtaaatataggtgaaatgtgaaatctaagtaggagagagggattaggaaatgtcatttaacttttttcctactcttcattttatttttaatatcatatttatatttcctttctaaaagtagtacgctatcagtgtaaaactatttggaaaacacaaaaagacagaaagaagacaagaaaatcaccattgatattactattaccacttaaagaaaaagttattcttaatattttggtgtgtatatgtatgtgtgcatgcaacaacataggattatgcaaggttatgattctgatttttcaactagcaatatattatgaatatttgtttctgtcaatattttttgtgacatgatttttttaattgattatatagtattccatacaatggatgtgttataatttacctagctgatctctaatttttggacatgtaagttgcttccaatttttctccagtaaacatgaattacaatgaatattattgtgacaatcttttttataaacatccctgattatgtcatcaggtaaatacttaagtgtaataattgaatcaaagatatatgtattttaagggttttgatacatttagctataccatttacacattgctgtgtctgtcccagcagtctctgaaagtatctatttgttcatatcctcatcagttcttggcataaaacttaatatggttcaaagaaaaactctcagtggtctgggaagaatgaatacaaagaggtgggaagaggtcaagcagaggtaagtgatgtttttgtctaagagatgttgcaggcagcctcaggctatggagaacagctttctccaaagcaaacttgcactttcaaaggcggcccggactctgcgtgctaacttggcacagttgagatgtctctgtttgctttaaggcagtggcctgacccttcaagcacaccccatgtattcagtgatcgagaccacttactcatactaatcattgcacacagaaaatacataaaagatttgtattcatcactcaatatattttgctcctcaagtgtcatgaaacattcagggtacattaactggcaaatgcacacctggagtatgttacttagctttagaaactgctaatttttaaaaaatcaaatatttaattttgaggaaaaaaatcagttttggattttgagcatatatatcatctttcattttggcccaattaacccagcaggtgtgtgtaaattaggtcactactttgtcaccgtggtaacatgcattggggaggtggatcttaaccacctccagcacaggtgatgttggctgagttggtattaagaggtgctttagaaacaaacaaggcagaatttaatatgttagagtgtagaaaataggtctgacgtcggataccaacagataattctatcacacaaaagcaagtactgcctcaaatccgtataaataaggaagatctaatgagcctcagaaacaggaattgtattgtaaaacttactgacaatctctgaaagaacagacactatagcactcaggaggcggtagtctcatttcctcatggagcaagggatttgaaggtcagggtcaggttctctgcaatttaaggctgtttttagaactaagccgtggttttcggaggatcaacaacttcctgactactcattccagtgactagattttagtcactactgagggtttttttttaaagtgcagtgtctaattatttcttttaaatgctgtttggatcattattcataattgtttatgggttaagaagttggcagagttggtttatgccagcactccagcactcatacagtccccataactcaggcttcttctcaccaggtggaaaatcagacatgcttcaagatcgctagttgagattgtgcaatctgtttggctgctaaaggttccaaattatgtgggcattctgcagccccacagagtggtagaatttcttcacttatcactgacaagttcacacttctttgggtcactaaaattgtaaatttgcattatcagatgcagaaaacaggccaaattaataatgttaaatatatgtccaaggaaatgcatctcccatgaccatttgcagcacccagatacggatgataattccatcgaggctttggtgccaattcgtacctggctttataattttcagtttgcccttatgtcctgctttacatttgtatagcttgttataatcttgaagcatttttgtgtaccatatttcttttttgtgtgttattttagacatggcatttcagaaacttgaatgagcctagtgtttattttcagttggttgtgaccgcagctttattagttattttgtgtgttttcaataattgttaatatttacaaaacactgaacaaacctcttcaagattgctttacataatctccttttccatgtgtcaaggatgagagctacagagagaagagtcatagtgactcaccccgtatcacagagtatgtgaatttactttcaaaggagagtcaagggtccctggttttcagttcttttttttttttttttttttaattctccaagagtcatgcaggtttggagacttacaaagggatagcattgctgagtggagaaacatttgactcaagtactcttttacccctaacatctattttaccatttccctccctatattcaagtcttcttttccatcatctctccagtagatgctgaaaaccatttctttttgaagagctggttcatatgataaagacccaaagtctcaataaaatctattaacctgttaagggtaagtgtatgcattgttcactggagagcatgatgccatattctaccctgtctgcttgggaacaaggccgatggcagcacaaattagcatcagaacagagctttatcgcagtggaatcccaggttgttttaggaatgagacacgaaacaaaaatagataaagggattaaatctatcaaatataatagaggaaattgtagtagattcagggaacttggacccctgaattgtagtaaccaaactggagaggaaatggacagttaaacaaagtagggctgtttctttttttcattgtttgatgaaataatttttgccccttttaaatggtatgttaaaagagaaagagggagcctggtatatctgaaacaaagagcttacacagtcaccaagctggttggtttttataccttcctttactgagtattgtccttcagtacaatacagagccatttctttgttctcacaagctagcagttaaattgtatgtaaatgtatgcaaattagatgctgtctaataaagagagtcattagatggaagaaatatttagtttagaaaaaaaagcaggtgtattgtgtaaaagaaaatgtaaggctacaaaaaaagcccaaacttttgtggacagttatagaaaaaattattaaaatagatttttaaaagacttacgtcttcctgacctttcttttgtgcttatatatatgtgtgtgttttaaaaatatttacatataaaactaagggattggcttctttcccagaattactggaagcaccttcaccaggaacatttggacttgaataatctccacagcagcattttccttcttgaattaaatgaattgtaaaatgaatgatttgcccaagaacactgactgcttatttgggttcctttcccgtaggttgatagaggcttagtggctccatgatgtgtatcttgctattttaaggtttcctttccacactactccactccagcctctctaatatgaacttcttaatagagacctagactataagctccttgagaggaaccaacagttccttttaaactttatcaatgctgtattcagtgtttagcacaatgcctagtatttactagcacttctatctattttttaataaatgaatggttggttttaatggttgattaagtagttatgggtatgtcaaacacctttgtattctctagcatatagttattgaaacaatttctcaggcttgcatttagcaattatatagtaaatgcctagtgaaaaaaatagtttaccatccagtttccttaagccaactgtaacaaaggtgttgagtgttcaccactacattatttattgtggcagctatttctggggcaaaaatgaataggcagcatagttctgtttaggagcagctaatctactaaaggtatcagatagatatacacatatttaataaatagtacactgtactatggaagcatgagataaaatattatggaagcattagagagaaagagagaatttccaatctatgggtatcataggtggtttcttggaggaaagtggaactgaactaagcctcgaagttggtaaggaacagatggttggctatggtagggtggagaaaagcagagttgcagaattctcttatgttgtagtcccaaattaatagtaatgtactagattttcttctcctctcttgtgaatttccagcaacagcttgattttaacctccacagaaacacaaatgagagctgtgatggaaacaataattactagagtccagttttaactccaagtcaaaattttagtcacattcagccctgaataagaaataaggcaaagcatgcaacaggactttataactttttaattttaaggcattataaatataaatttttattttatcttatttttttagagatggggtcttgctctgttgcccagacaggagtgtagtggcaccttcttagcttactgcagccttgaactgttgggctcaagcgatccttctgcctcagcctgctgagtatgaggatgcaaaggcataagaatgacacaatggactttagggaccagggggaaagggtgtgagggataaaagactacaaattgtgtgcagtgtatactgctcaagtgatgagtgcaccaaaatctcacaaatcaccactaaagaacttactcatgtaaccaaacaccacctgttccccaataacctatgagaataaaaaattaaaaaaaaaaaaaacaaactacaggtgcatgccaccataccccgctaattttaaaaaaaattttgtagagatggggatcttgctgttttgcccaggctggtcttgaactcctggcctcaagtgatcttcctgccttggcctcccaaagtgctggggttacaggtgtgagccactgcactgagcctaaaatttattattcataatgtataatattgtccatggtgtgaaataaaatttgggggataggagatttagggacctagaatggaatacctcatgtacgtaaagtgtcttgcagttcacaaagcaccttcctaaattattattttaattacagttattgaggtagcagaactggtgttattattttaattttgcagatgagggaactgaggttccaaaaagttaaatcacttagccaggaaatgtcatagccaggtttttctgataggttgtccagttctttccacatgcctcattgtcacccagaagcaacacaagggagggttatatagttctatataactctctctatgcttctatacgcatcatatatcttgttttctaatgttattctaaatatttttcattcacttggttttatatccccattttctccattttaacatgggtaaaatatgtaagacccaaactgagggagatgtgtatgggtaagaaactgattattttggtaactggtatggatatgaaaaccataacgagtctgtggattgcaagcattttaatttattttcttgacttttgagttaaagaaaagatttcaatgtgaaggtgcaaaatatgctgcactgaactaatcttggaggtaaccaaagggctgtgggactaacagcttttgatattacttagtgcttattattgttattattattatttctttttaattatgcaaagtgctaatcagtttgattatgcacagtgctaatcaggttaattatgcaaagtgctaatcagttcttcttgaagcacacgaggagagcagaggtgctggcggtgaatggcatagctagatgggggtagtcacggcagtcattccttattaagataggagtagacaagatagcaagggggatttatccataaaaataaataggaaaagaaagaggactatgagcacatgaaagattgtagtttgggcaggacattgcttacacatagaaagctcctcccccctgtagcatagtttggttggatagtctctgctatattttgaaggcactcatttgaagccaaaaagactgtagagggaaggaaacagagtattgtatagctagacaagttgtcaaaacaacttattgtagttggcaagcaccaattcctgggaggacagtaaaggaagtagaatctaatagacctgtacatgaaaaaggacatcaataaagagaactgaaaaattaagggagtgccattctgataaaataaacagggccatctcactgctgcattgttactgggacggccgtctgtgtagcctgtttcctgaggtgaactgagggctggcttcttggtgctggcagtggtctctattgagagtggtgatgacgaatatgacaataagggttttatgtaatagctcctagttggatcagctttgctgctgctgaaatcaaagtgaattttaatattaacttgcaggtctgtgcttattaagctgtgtgacttcctgtgaagatgagtttatagcaatatgttcatatgtttttacagaacaatcatgatggtgctcccttaagaatgccctttgtattctgtcctcctgttctattctgtggtttgataagctatcaatgaaatgctgtgatatctacttgtttgaatgtattcagagagcaaaaagcatttcaggattgtttagtgaatattcatttttttaaaaaatgttttcagtccatgagatttttcctttactctggagtttaagcaaatgtatacgttatttataaaagggagggtctgcttccctctatataacctgacagaatatttatttaccttttctttttaagcctatgtctaagcacagctcatcttcacaaactgaagtggatcttgatttctggaaatgtccaaataatggtaagagtgctacagaggcaaagtcattgatgatacctccagaataggatgtattcataagttatttgtccaggcagtgttggttcttggataaagacaggctttcagttttcataatttctttaacctggaacaatttcattttaaaatatgaagagaatgacataaatctttggtttccaaggagagtctggaaagaaatagattgttagaggacagcgcccacaaattgagaaagcctgttgggggccctttgggaatttggctggaaaattatgttataagcagtccttctgctcagcttcatgggaacatggttttagaaatgaaatattgcttctgtgttccccaccccccaaaactaagacaaagatgaaatattcatattatcctttattttcagaaccttttgtgttatttctcaatatgttaaaaaactttccttaattccttaatgattctgcccaaagggtactttgtaaattctattcattgatggtgtactaaactcttaattcctggtgaaggcatttgaagccaaagaccttgctacataagacatttataatgtcactgggatgtttaaaggagaaaatcatgtgatccaaatggcaaataaaaataaatttagtaacatctaactaaatatgaccagttttccatttaattacatgcttgcacccactttacacacattcacatatatgaacccgttaattccttcactaaaccgtgttatttgagcacctgattttttttaagtgctcactatgtgctagttatagtaccataaactctcctagatactggagatacagttgaccataaaagagacaagatacctggcctcgtggagctcactcacacaggataacatgatagtttctcatgatattcagccttagaaaccaagcttttgtatttcatttcttctcagaacttcttttagcaatctatatgattcaattactgggcctcagtatcttcaattagtctcaaaataagaggtaggacttgatggttctcaaggcaccttcatgtcattcatattcactgtcctaaagtctattagttgattagactatgaagtgaaatgtatccattattaccatatgagcagccttgaaatcatacagagttctttgggactttgatcttttaggaaataagtaatttctagctaattctgtggacactacctccttggatttaggccaaaattgaatttagaaagggcggactttgaaatattccacagtttgaattttggcacttgcagttactagctgagcaagtcataaccaaccactttgatcctctgattcctcttagtttgtacttcaaacagtgagtatgagtatttaataaatactccatagtcagtccttttttttttttatttctggcaactgtaggcttcatgactcttgttaccaaaaatgtcttcaactaattcaacttcctttccccaaacgtcttatttctgcattaagccattacttcagttaactcagtattttctctcccattacatctttacagttttatttcttcctgttctctttcttatgtgcttttacttctctactcaacctgagtcaacttttggctacttaaattatcatatgtaacataatcttggttacaacacaaaatgtgtgcaactataattcaagtcaattaaatagaaatatgttttctacatcagacctgtgccgtagttgtttatatttttgacttactagtgtactggaaacctcttgagtacaagggttgtggttttaatccttgtgttcccagtatctagcatggattctgccagtaagcatgtcacaatctagcaagaagaaagaatttgaaagcagtaggaattttaaagcaacaggatatatgatctgttagtaggaaagtggagatgttgggaaaggctcatggaatagatattgggaaggctttatggagcaaataatatttgagtttgcttatttaaaaagggtacttattctttttttcctggcgggaagtgaaagtaaactctaggcagagagaagatcatgaaaagactcatgcatacataaagttgggaggaactgggaccaggagacagaaacgaagacaagaagggaagattaggagcatattttgaaggtcctatgtgttgtttagtcttacttgaataatcttagctttccaaaataagtatatatagttgtggtatagagagtgtggtgttgcaataagatgatcattagcttttttatgaagaagaaataataagacttagcaactgattaatacaagaaaaaagacaatgagagatcatgtcagaaagaacatctggatctgggttgcagccccactccacacttgatttgtgaccttaaatacttaacttcatcttcctaaaccacatatcttttaagatcactcactcactgattattattgaagagggcccctattccggatgctttggatcccagaggttgagaataattggtgttttttaaggagaaagatacattttataccagtagcacatttagcctaagctggtattagggcatttgggaagatgaaaaggaagacatataaaagcaatatgttctggccagaaaaaggcaaaaaggaccctaaaactaaagtagagttatagcttagagtatctaagaaggcagagatactgaaagatgtatttagcagagctctgcatttgggggtgaacatctatccatggacctaaagagatcatagattgccctgatttgtctaccctctatgtaggaagttaactcctgtgattggtaactaaccaaaaaattaaaagaaaggggagatggggcaggggagataataagagggtatttgccagtggtttacaaagctttgaggtgtacgtgtatgtggttgggacaaggttaatttcatgtcagtagtcatggccttctcctttcttgtatcacagaaaagacttcttcttctcattctcttccatttcttctaagaactctcttcatgccagctaggtgtcaaaacttgggtagtgtggaattgggggaatgaaaaatagaactggaaaagtgatcataggggaggggaactcaaaagtgacaaaatttcacttgggtaaaaggaaggggctagagacaggaaaaatgaggagggaggaaagaaaagtacccataagggatagaagggatggagaaaagacttagaggtgaaagtaagggtagagagagacttttgatgcaaagtggttgtccatgtggagaataaagtggccaagactaagaacagagattttctgtcttattcttcttggtattttcttgagaaactgaatgaaatttgactttttaatatatattgaggggtgtgtgcgtgtgtctgtctgtctgtttctgcttggctgctatttctttggatcaaaactagggattacctgtgcagcaactttgttcccacattcccaccaccatcaccactgaagcaaggctcagaattttcagtcctttttagtcagtagacttctgtgattaatgctccattaatcacttgttcttcgtattaagtataaccccataaaaatatgggattggagggagaatggtcaaccagtatgtgattcatactagatgacagtcctctcaagatggccctaatttcttgtgcatttcacctacatgctgatcttaattcatgtgtttttacttgataggggtcagatgaacaaagtaatttcatattaactatgacaaatttgtgcataggtgaaagaaaagacctctacttttcagacattattattttctggaataatctttggggattaggtagccaattaatcaagatccccataagaaatgttagcaagtaagacaatatccagtaaaacactattagccaacattgttattcaggaattaaagttcaggtaggatagctttggcatcatgagattattctctgtgagactgacctattgccaatgacgtatatgtacatgctttaattgatgtgtgggaacttggtgccaccctactgctgagatttcaaggattgtgtgaagattttgtgacagtaattacacactttttatcagatagattttatgtattatcacatgtccaatttagaaattttcctttgtttttatttttggcattaaaaaaggaatgcatacttcataaacttacatttttgctatttgtttgtaagaaaggaattccaagtgggttatgtaacattaagcatatggctacacaaagattagaaaagctgtggccatcaggaataaatattggtgataacactgatgggatttcacacatatagtttattgtgagaaaatcagaaagacttgcacagaacttagataaggaaataggcttgttttttgatgaaaatataaaaggaagcatttgttattaacacggtaggctttgaaatttggctttctacttccacttaagaggaaacaccttaagtctgatgaattttttcctatggtagacagtacttaatctagtattactagattaaaccccttagtaatcaaacattttaaaccaataaaatatctctgaagagcaaaatgtaccactgctccagattcttccatgatgtcaaaaacatagaagcaacaaatgtggacctgatttagtagtcaagggaaaatatgatgtgatggagaattaataaaagactattttaatattgggaatgaaaaactaccacaaatcttaagggtttacattagcagaacttggtttggtttgagtagacttaaaacaagattttgagcgagcttctaaggagttttgaggatcattttttttctgtcatgaatttatgctacataacaaatgcagaaattggagaagtgtaaatctatcatttcttttgacatttatgtagcttcagtaacctcctaagttgagatcatttgagatttttagaacatggatacctctagaaaaaatgaggaggttccagtagctcctcagaaatagcttagcttcacattgaaggaagattcataaggtctttatggagcaaagatatttgatcagaacaaacattcttatcatatggaacctttttcctgcaaaaaaaaatgactgttagggtaattaaattggttatttgcagcttctctcctttcccctcttccctcttccacctgcacagtattgttatattgagttgccatgataagagtaaaaaataatcaaaccaacctatacacatttttattatgaacaaaaaatacttggaaggattctattgatacaagctaatgcaagataataatttgtttattcaaaagtgttttgaatgtccttttccattgatcatgtgcaactggtataaacaaagatcctatgtatggtagagagcttatatttgcatttctttgtatatttaagcatttttagcagacttacatttctgtttattgagagtactctttagaatttgtgcaatcatatgtatatatcagcagcagacatttgggtaggtagtgaaggtaagttctatagtcagtgtaactagaagattatataaattaattatattagttttgatgctttgggtaaaatcagtgtgctacatgaacctccagttacacaggacaatatactgtgctcaaaagacatgaaggcagactaagagtacagaaaagctgttggttttgtttggggagttcctggctttttatccgcttggggaaggagcaggtcttattgtcagttgccaagtgctctgatgctgagaagtttgtcagctgtggttactttggggattttggcaatgataagcacttttccttgagaaaaatcagcatagataccacacattggaattggacaaattgcttttattttctattttctttaaaaatcaaattggcttttccttcttgtcccagctgttgcagcttccttgttttttagcttagatgatgggagaaacacatgttccctgagatccagagtaaagcttacttattttcttcctgtacagactacgtgaagttacgatactggccccaaatctaactaaacaaagttattcagaagagatttgacagagagggtgtctaacaggtgttgagctggggtaattgaatgggtatttcaaagatattaatgtaactcgcatatattagaaagctttaattgccatctccagcatgtttagacctgaaaacttcagggacctaacctgttccatagagaagtctttttatgcccctatggtttatagctggaaacaaagtatgtatgtaagagttggattggggcaggtgcggtggctcactcctgtaatctcagcactttgagaggtggaggcaggtggatcacttgaggccaggagtttgagaccagcctggccaacatggtgagatcccatctctactgaaaataccaagttagccgggcgtggtggggtgcgtctgtaaccctggctactcaggaggctgagtcatgagaatcgctggaatctgggaggtggaggttgcaatgagacgagattgtgccagtgcactccaacctgggtgatagagctgaattggttgaagtagtacacagtaaggcactaaacaaacttgaccttttctataaattccttcactttccctgtaacctgttacttttcaaagggaaagatcacatctatatttctagtcagcttgctatcatggtaaggaaccaagattcccttccagttagggtagtggaagatgaaagtggcttttcttcttgatatctggatcaacctggttttcctgccatctcttatttcataaacaagcttatcatctgacctagctgcagatcgtgttttaaaatttgcccctacccctgctcctctcttaagagccgagtgcccacagaacattatcctcctcatctggacctatctttgctcttactgaagggggctttttcatcctataattccttttctgttggcttttcttgggaaagcagtttaagaaacattcattaactatttctgggtgtcagaaactatgtactatgtttccagagaattggaactaataaaatgtatacctgtatagaagagatgttttataaggaattgactcacatgactgtggaagctcacaagtcccaagatctatagtcagaaagctagagaccccagagagccaattgcgttagtccaacgtattagtccaaaggcttgagacctgggaaagctaatggtatagtcctagtctgaacttccttaggccagagacctgcagagagctgatgtttccagtttgagtctgaagacaggaaaaaaaaaggaatgttccagctcaaaggctgtcaagcaggagaaattccctattacctgtgagagagtcagcctttttgttctgttccagcctccaactgtttggagatgagggaggccaatctgctttactcagttactgattcaaatgttaatctcatccagaaacattctcactgaagtacaccaaataatgtttgaccaaatgtctgagcaccctgtggctcagtcaagttgacctataaaattagccattacacctccattacctaatttaatcctgaccaaaacacaaccccaaaccccatgaagtagacactattggttattatcaccaaatttaatgactaagagtaaggtgtctagagtgagattgcccttactagaattctgtcttcgccccttactgtataacaataggcaaattactcaaccttagtttcttcatctctaaatctgggatgataacactacatacttggttgagttattatgataattaaatggaataatgcatgtaaaacacttagcatcgataactggaacatagcttagtactcagtgaagaacagctattatttaaatacatgaggaaataaagtttcatagtggttaagatctttgcccaaggtcatgtagctagtaactggtgaaattgggatttgaacttaagctgtttgcctccaaaattatgcatttaattcctctctattaatcttaacacagaagtagaataatgtaatggttaagcctctggcgttggactccacggttcaaatcttggctatctcattcaccagaaggctttaggcaagttagttaacttatctgtactttagtttcttaatctctaaaacagaaatgaaatagtatctttcccggagtcacatagaatcagatcatttctagggatactaccttcatccatgaattttaaatgatataatttaagacacaagatttctcctttttccttcaaattatactggttgttattgatatgggtaagtaagatttatgaaatctagtgaagcactaaaaatatgctaacatattcgtaatgttacagatagcatggctttgcaacaaatttcttcagaaacttttttgagagggagaatgaaaatgatagttttcattcagaataattgtaagtgtcttcaaaatgaagttcaaatccatgtataggaggtggaaggaagccaagaaggaatccattataaggtgaaaatcataagtcctctttttgtgactctatcttgcccgtttaatagaagtgatataagtaagatctgccacctaggaccaaatatttctttctctagtacttaagacaagaagacgcagaatttcagaatactgtatgtgggttctcatctgtcaaccaaaagcagctgaaaaggcgagagccctggagaaatgtttcctacatatgtatttgtttttagacaaatgtgtttgtttaaaagtctaaaaaccatggaaatgggtaccatggaaatgcatagttgaggggtagaagccctagaagtgttgactcaattcttgatccttctgtgtgatgtattaaatgccacatgcttcagtttgctgtgtgtggggtctttcagcactatttataatagatggcaatcctgtgtgaaggacataagaaaatttctgattcgtttttcaagagactaatgagaagttggttgtcatctggctgttgcttatgggaggaaaactccagagaaaattataatgtgtatattactcttccttccaaaaaaattttatttgaggttaaaattaatattaagggcagccgtaaaggggaaacataaaatccatatgcagattgaagaagtgtggcaatgaaggggcaaaagttggagttaccctcttgcctcaagtggttggagaaattgtaagccaattgcatatatttcagtcttaacacttttgtatacttctcaatttcttttaaaatttaactccggaagtcatagttagaaatttgtcttctttaccaacttcctccatgcattacctatcgcccatctacctcctaaaatttggagtcttctcaaagcaggcaatatttgtagatagtattatatgaaaatgttggaatccagtgaaaatttttatggtaaacatagatggaaatgtcctctttgctataagatagtagctactttaagtattttttcctttgaataatgttgttcatgtcaattgccaaaaaaaaaaatccttgtaattatatgaaaataaaaaggaaaaaatacttaagaaataggagaccaggagggaaattataattgaatctggaaaccattttttttaaccttggctaaataaataagaaatgataagaggtacaatacaataagaaatgagagatactgaggttcaagcagactgctttatttaactccatttaattttattggattgaatttgatggagacaatgtcaatggacatatatatgaagattggtagcagaattcctggggctgttttatcattgtcatgaacatgtacaaacagaaagggaatgctaagtaattctgaatgtactagtgatttttagataacagatttcagttttacaaattcactgagccagcaggtggaagcagatctgtcacctgtatctagttcttgatttcaatatactaggaaagcaaatacatcaatatcacatttttttcttttcttcctttgccaagatgtatttaggatgttttctcagcattacagaactctcagctaaaagatacgtttcagtttcatttttagaggaagaagaaaatgttaagtgggctgctagcaatttttaattgctgatagcaattaaacaccaaacttaatgtcccttggcctctttggttttcttatagagtgaagtttatatactatagctgaagaattagtttacaagcagaaatacttgtaaaagctgcattttgtgtcctacaagtgaacccaaaggaagtgatattgccttcaagtaacagaacctctcgggcagattatcagagtaaaataaattcagatatgtatacccctcaacaagctatactttggtaagttatgttttgacagaatttgtttagtggacagaggtaggccatgttattgtcccacagggtaacctcaaatgaggtcattagccctggaagcagtgatttccaattagcccatatgtgatagagttgcaaactcttaccaaagactttattaatctctagataatttatcttctaatactttgtgcccttctttatttcttttttattgtagtggcattattcttgaacttatccattaagagttgtaactaggttccaatttgaagaagcccagatgaagcttcagattgtgtttgtatagaacaagttaagaactggcaatatgaataactaatatagataactcagacatttcagaactaatcatttgacctaaattaatttcttagatattggtcagattctctaggtgattttcagatatcccctccactttatggatatatgttgtaattaatcagtatacttactttttgctataatgtcctcctggctactcagaagaaaaccaagtaattgaagccttagtaaattaggagggtaacatggtaaaaacaaacagaagtcactggttcatagaaaaatcttgcctcataattgcattgtatatgaagatattttcctcttatgcccataaacagtaatttaagttctgaaataaggaccttgtctttattcctagaacctcttccaatacctggcacatagtatgtattcaataaataattgttgaataaatgaactttattgtaaagaggatcactattatcctagatttggttatatattgggtcaaataaaatctcttcccttctcctctgcttccaaaagaaaatgtttaatatgatgcccccaacttacaaacaggttgtgtttcaaaattcagacagtttagttttctggaaccaagaaagcttcccttatttatacacttattgcaacaaataccaactgaaccctcactaccatccaggtatgttataggctcggagcatacaatagtgaataagacaccaagtccttgttcacatggactcgtacactttccctcctagaactagatctcttagaactgtgcctggcacaaggtgcacactcaataattgataactactatttttaaagaataaccctactattttcaaggatgtttattcgagttttgaactgagctatcaggtgacttcatatcccaaaacaaaatttgaatggaagcactaggttaaaaaaaaaaaaacagatgccattttaggtatgttcttatcctattttattaatcttccctgggcatccactttcaaaacagaggcatcttaccactttaaaaaaaattatttaccgtgtggccctggcaagtcatagccatgtgactctcacctaaaaataatgaagatatgataatattctaattcacaaagagaacacagcagaacttagtaaattaatgtttgcacagtgcttagaaatctgaggttgtaattgctaaaagaaatgtacagaactattattgctactaaaattatgatagacacttttttctaccaaaaaaatacctcagtgaattggtgtttatatttttaaagttgtatgccacattaaagaaaatgttctatgtgtatctaaaggaaaaacaaataagaatcatgtccctttgttattatgtgatataaaattgcaagggattcactattttggggaaagtaaatagtatttaagaccttatgattcaccagtttggacagatggatgattgcatcttcttacgtaagtgacaggtggcagctctagtgaaatggcttccaaagttcttctgatttttgcttctctttcttatctgttctttggcttggagcaaagtggcaatgcactccaattacaagagtaaggagagttttggagggctgaggtttcgtttttggggggtgtgtgtgtgtgtgtgtttgtgtgtgtgtgtgtgtgtgtggtgtgtgtcttgtcagcattttggttaactccatctattcagtaatctagctaaatggtgggtaataaatgccccacagcaacaggctgtgatttcaaaccaggtctgaacacattcttcctggaatagttattcttccacatagactttgttaattgtctagaatgtgaagggtcattgtaggtgataccttctcttatcagcagaaaataaggtgaggcttaaactgtacaacttaaaggagaataaatttttaaattttaagtattatttatttgacaaatatatagtgagcacctaccatatattaggcacagtactggacactagcaataaactaaggaataagacaaagtatttggttcaaagaagttaaattttattaggggagacagataataagcagtacataatttccggaaaaaaataaatactatgaaaaataataaagtgagataggtagagtaaagttggcaagctatttcagatgtgatggtcagtgtaagtctcctgaagaggtgacatttgaggagaaaccagaataaagagagaagcatgctaaaccctagaggaagagcattccagtcatgggtaacaaaaggtctaaaggccctgaggtgggacttagcttggtgtgtatcagcaaagaagtacttaatgagctttgaaagtctttacaatactgaaaagccagacatagagggttccattcaatctacacatacttgccttatacaacctgtagggttggaagacatgcttatgaggcgattcccagtttcagatcttaagatgtttttgtgatactcttgattttagtgaaaccataaaaaagagtaaaatgccttctgtcaagtagcacaggactatgtctattctgataaaacctgaactttagtccctgaagatgcttttgaaagagaatgccacaagacagttaaagcacaccagtaagatctccaggatgactgtgagggcaggaagtaaagtgaaagcacagcactgcaggtgctttattttcacctttcttccacttagaaagcaactcttctcacaattatcctatagtgcctcctaccctttggtttaactgaccatgtaagatgcattgagtatgagggctatctgttgtaatgacgtaatctctaatgttattctgcctatggaaatctctgattgttctggtaatgctgacacttcttacattatgacaaccattcttgaagagttttgtgaagattaaaaaaaattaagccacagtgtttgatatactagggattgccatctcccccatgaaggcctatagcaaatcattttgtaaaacacatattcagatcctaattttgttgtaatttcagaattttttttttttttgagacggagtcttgctctgttgtcaggctggagtgcagtggcacgatctcggctcactgcaacctccacctcccggtttcaagcgattcccctgcctcagcctcccgagtagctgggactacagtcacacgccaacaagcccggctaattttttgtattttagtagagatggggtttcaccctgttggccaggatggtcttgatctcctgacgtcgtgatccacccatcttggcctcccaaagtgctaggattacaggtgtgagccaccgcgcccggctgtaatttcagaattatagatattgaatgtccatagtgacaaacacctataaaaatagaaaactctccagtactgtttttggaacctgaaagattgggttagtcatttattctgttttgttgttcaaacattgttttaagcctcagatttcaacctatatatatagaatagcagagaggggatgaggtctattagtgacattgtagttgtaaaagtgcagtttgaacctttgctttatttatgtacatactgtactgtcgtttgctctgtgcctttataaaagtaatcaaaaaaaagtatttcttcactagctattgcagtcttttataaaagactgcctttgcttagagcatgctatatattgcagtgtggaatattggaggccattataagaatgtttggaaatagcttgacccctgaaagatatctataaactcaaaaaaaaaaaaaaaaaacgccataagaagttatctaaatttccccctaagttagcatgatgaatagtaaaagcatgtggattctgaaacaaaaatattattttcttactcaaatttttgcacctcctccaccaaattgaaggaaggaaggaaagaagagagaaactaagggagagaagcacgagaaaagaaaaggaagaaggaaggaaggaaggaagaaaggaaggagaagagagggagagaggaaaaaggaaagaagaaaggaaggaaggcaagaaggaaggaaggaaagaaggaaggaagaaaggaaggaaggaagaatggaaggaaggaggaaaagaaagaagaaaggaaggaaagaaggaaggaaggaggaaaggaaggaacgaaggaaggaaggaagaaaggtgggcaggcaggcagcagaagggagaggaagaattctcttgtcatgtgaaatgctcttgtgaaatttttcaggcattttctgtttttttaaaaaatattttttttctcatcatacaaccttgaaagttgactggcttactgtcagatgcattaactaaatgcaatttctgtttttaataatgatagctcaaacttcatgtgagatcataccagccatacaatgtaattcagtttatggttttcttatatacttcaaatacctgcaatatgtagttaatagtactttttttagataagtagtaggacatcacaacagtgatgttatggtgggctggtatatgtcagtaaagtagattccactaaaaaatggaaaatacaagatattttggtgtaatttgtctaaaaatattcatgacaaagaagtctcttttactttaatgtccaaagtgataagatgctgatgtgtctgaatgaaggaaaagggtgtgaagcaaagactgcactttctaagctgaagaatgtttctgcactgcacggagctcaaatacaactttatggtagggaatgtgcacttaagattagactagtagctcctaaagcaaatatgatgtccatgatttctttcaacatcacacacacacacacacacacacacacgaatacacgcacaagtagaaactgcaggtgcttcctttttattgcactatgtaaagagaaaatgtaaaatggacaagctttcgacaatcatgttctcttcatcaagctgttattgttattttagtgagtccactaaaaagaattatctagagcttcttgtttttacttctttgtgtagttgatgaatatgattaccatttttacctcctgtatttaaacccctctgccataatcccatattctgcctaaaagccatgtctgtgggagcttgttccctgcaatcgtttttagggatataactgcgtttaagcaggtgcagtaaatgcagttttggccatttttactgttgtatgcaagtgaaaaatgcctaatataattaagctgagattaatagagattattagtaaaaataagcttgttttatgaatgaagacctcacactaattcaacatggcctttctttgacaaatgcactgtattcacttatgtagcacaacattgtatgcctgaaaagtgaataaacatttacaaggctaccttccagaattttccattaatcgtcttctaattcttttcctgtggccagcaagaggaatccgattttatttttaagtggaacaaagggattggcctagcaccacaagggacactgattgtcagaagcacaagttatctttagttaattttgttactgaattgttcttggttctttttctcacttttagaattttaagcatcctattcaaaatggccaccatacaggggaggtgggagagaaggaaaataataaagaacagtggcaactgagttgattctgtataaataagcacatttgctgcatctctgttctgcagtttttatgtcccactgatgagagaactggtttgagatgtaaattgctttcctttgattgaaccagggaggagatgtcatgtaactcatctcatcagcatagagcattgtgtgcctttggtgaattataggataacggcgctagtaagaattccttaacctctctccgcagccctgttccagtgcttaataaccaccaaggggaagtacttccctacagttcacctgactaccttctgtggttttagcttatttattcatatcctgtccttaaatattttgtaaaggatcacgggaaagtgccagtgttttaccgtgccagatacaccctgcacattaaaatataaaattgcgaggagttttaatgtttgtttgttttaggtagagagcacttagaaggtggctttggaaagatgagaaaggtgatgaagacgtgatctcaaagcaatatttaccatttatctcacttgtcaagatttaggataaacctgtagaagcagctatgcatgaaaatggaggatggggtaggagtagaggtagaagtgggggtaagaactccctgtgatatccatgagattatgtgctgtatgagaaaagaatcaggaagtggaatgtgaaacaaaagaactggaaataggcctgcaatcaatctagcttggtatctcaacaaaccagtgacttttttttaatatgtaagaaattcagggcagatattacagccctatcatgacagcacggccttttcttcctcctcttctattaaatctacattttgaaggtggatggtgctgactcataaattaaattggagtaatacatacagtgtatatatatttctgtcactttgtctcaaattaaacacgaaccttctcccctgacaagatgatagaaaagttaattgctcgccctggctttaaattggaatttgaatttgcaaaatgctaaaggtttatgagatctaaatcatgaggagcttaaattacattcctgtgataaaatattaataaatcaattaaaacataagccgagtataatattactttttttttgtaagaaccttgaacacaataattcattagggtgtagtgcagtaacaattattgtatctttttttaattttctttttattagttttttttgataaatacatcatcagataacattccacatggtggattatcattaccccaatgcagcttccagaaattctgttgtacccctaaacaagagctcacaggctgaattgtctgctcttatttatccttgttagcatcagctgcttcttttactgaaggggtatttgcctcttgggaacatctgttcaatgccaactctgccattttgtggtttctgaatctctcttccaaaaatgggcataatcataataatactacctcagaactggcatgaagatcaaattagataatgtatgtggaaatcatttgtaggtggtaaaggaccatcaaatgttaattattattatcatagattggggaattttttatctctagaagggctcttagacgtcacttagtaatcaaccccctcattttaaatctgaaggatcagagaggtccagagaggttaagccacttgtctaataccacacagccagaaagtgaaactgctgaaactgaaattaagacttgtaaatcccacctcagggtgtttttcactctctataccctaacgcctccctaaaataatgctaggaaggtcacgttaagtttgggttatttactctcgccacataactttcgctttgaagctgctatttttctgttgttgttgttgttttgactgactaaacattagttattttagggataattttctaaggggcctggtggcacaaacacatatccccacagctgtcaggaaaggttcatttggctaaggaggcactgccttctcctgctgctccccaaatgaagactcagcagtgtatcttcctctcctacagggttctggaggaagcctcagatgaggagaggtagtagctttcctttttaaatacttctgtcatgtaatgacggatgaggattcacccaccacgaattttatctcctttacctccttcttgctctctggccctagtttttggtttaccttcccctttctcccaagttccaggaatcactcggacattttatttattttgaacataaagagaaccatctccataataccttttccagaaaataataattggaaatgaatagatgtttcttcctttcatgctaggaaaacactagctcaacagactatcagcagatcagagaataagagactgtgtgctaatcctgtttttcctggtaacatgggatatatctgacaagttttcatcattctgtctttgttttcccttcccaacaatagaaataacaaaatcaatctatactagtagtttgaagacctccattaaataattacgaaaggttcacaaatgataaagagttatacaaatgctatataatagtaatctgtgatcttctaggaataagctaaggcagagtggataagttctatgagatctataacatttacatacttataacacacacataattattgattgatagtgatgtggtttttacagaatattcgatgcattatggccaaagaagatatggtctctgtcgtaaagatttaagattaggataaattattttacaagagaaaacagaagaagtttagacaaaagaaagctgattgaagcagagaaactattggaactataagattagtcaaggaaattaacaaaaagtagattttaaggaagctagagtctttggtgacatttagaaaaaaagtgaaatgattcattgaataaaataattactgatcagagtgcagcaatgtatccattgtcaaatgtcataaagcttcaattaaaaacacagaaataagcaaaatatacttttaagaaggcaaatgagatttgatgaaatccaagaacttcacatattagatagccctgcagggtatcagtgattaaattcattttatggataaggaaacagattcagggacgttaagtgatgagcacaaaaacacagtcaggattcaaaccaggtctgtctgactccaaagctgctttctcttttcattaccctatgcaatcttttgcagccaatttaaagccacagaaaacataccaaagaaacaaagacaaaaactatacaaatgtactggagaagaggaggcgggaaaacagaaagtgttttttctagaggcagactcactgatggcaatgagaactgaaatagaagtgagtaccttggctaaacaactaggaaaaaacacacaaaagaatcatgaaagtatttatataacttccctgttagcctctattatctttgatagtagtgtaatattttatttggattatcttttattattaaggctcttatcattttctagttgttagtatacaaagtattttgacacatattatgtcattttccactcacagaaaacttatattgcaagaaaggaagtattgctattcctgttttacagatgggagaactgaggcttgggtgggctaaatgatgtgtcaaaactttattaataataagtaacagaaagaacttaagaatctggaactactcactccagtacatttctaccatatcaagtcacttatttgtttcagaaaataggaactcattgtaaagattttcatcttaaagtttaaaagaaaactgcttaaacaggtaactagaaaatttacttacaacaaatgcctcattttcctattactcttctattatagaaaacaatgaagcattgcagaagctaattttaaagattaaagcaactcacacataactttgctactcacatgaggtcattttacagatactaattggggtcctctaacttcttttccacatataccatgttatttgtcattctacaatcaaagttttaatttataacttcatctggtagtctaaagtttagtttagatttttaaaatctcctatttaaatgcaaatatgcttatgaggggaaatataaatggtcaatgaatgtgaatgctgtagttgacaccttacaacaggacaccttacaagggattagtccaggggtttaaggacaaggacgggcaagcacttgattgagagaaggattggagaggagctaataagtgaagttttgtttttgccatttaggaggccacagatgaaaaactaaatgcaacactgtcgcatatgttgctgtgcaacaaacaattaaatagaaaatgagatgcatataaaaaagccttttcttacagaaggcaggtacactctcaaatcagaaaccatgggatatttcgaaatttagaacagggacaatgtcgagagtattttaaatataggcagcaggtagaacatccaaaagttgatggacacatgctccagttacttacatgcaacaggaaagtgtgaggctataggtggtctgcagaagggttgctaaggcttgttctacaacagatgataacagaggaggtggcagtgaatgaggaatgacaccagcctgccacatgtgccaaaagcaggatgcatgggtggcaaggtggagaagataaaccacaccagcctttgccactgttgatcaccttcaggagaagagaaataaggaaatattagatcatgacttggaaaatgtatcaggcaggactttgtgcaagccctttggaactcccgctaatctaaatggggaagacaagacactgagaacactaagcagatccatatctcttgaacaatgtgcacggtcgagttggtgagaaaggtaaaacataacaggaaatatggtaccaaaaagaaactccctgaagtcctcagtttactgtgccagcctctttcctgcagcaaacagctgatagaattaactcagtgaaaaatgaaaactaatcagaaaggaacctgcattggacccagatttagctatcagctaagcaaagctaatagctttaaacaaaaacaaaagcaatacaaagaaaccagatcaaaacatataccacaagaagaattatacaagaaaataatatctattttccatactagcaaataaatagaagacattgtggcctccttaaaataaaaggtcaaggccaggtacggtgtggctcacacctgtaatctcagcagtttgggaggctgcggcgggtggatcagctgaggtcgggagtttgagaccagcctggccagcatggtgaaaccccctctctactaaaaatacaaaaattagccgggcatggtggtgggcgcctgtaatcccagccactcggtagactgaggcaggagaatcacttgaagctgggaggtggaggttgcagtgagccgagattgtaccactgcactccagctagggcaacagagcaagactctgtctcaaaaaataaaataaataaaataaaataaaataaaatgaaagttcaaaaactagataaacaggattgaataagtgataagacaaataaggagaaataaaattgtctgtgagagaacaagaaggaagtagaagaagaaaataaaactctaatgggaccaaaaaccatataggaagcaaaaagctgggagaggaaggagaagaacttctactgatattaccacaattgtgaataagaaaaatcaagcaaataaaaatttaaaaaacagtttttacatgatatgaaaaagtgatcattttgattggcaactcgtatctcagacaaaaatagtatctccaaaaaataagagctcctgcgaattgataagaaaaaagaccaataactttttaaaattaattttttgcttaagaggcattacagaatttacagaaaataagtatgtatagatatagataaaacagtgttcggaggaatatccatatctttaaacatgactattacaggaaagaaaataattataaacgtattaccattcatctcatgaagttggttaaaagaacaaaaaacaaatctgcaaagtagaaacaaggaattgattaaaaaaataaagtcagaagttaaggaattagaaaataaaaaagagacacactaataaatcaaagagttggttttttcaaagagaataacagaacaataaacaaaccaatatcacatgatttaattactaaatgagaaatcccacaaatgcacaaaattggaaatacaatggggaaataaccagagaaatggaggaaattaaaatgattataatgaatactttatatatatatgtgaaaaatttgaacataagggataaattttaagtaaatataaattacaggaaaagactcaagagaaatacaaaagaaattcagaaagtttctgggctaccactaaaataaataaattgtgtgtatgtgtgtatacctgtgtgtgtatctactaaatgaataaatcagtcaactttgtaaagagacaattttatttcttcttacctcttaaatgtgttaccaacttttttccattagcattgaatagtcaagaaaacatcacactagatttctgttttttcttgcatgagtagatatcttgtctcattgatttgctttactgagtcatgtggagccaagtagagaaacaggctgactcggcatccctcacacagatttcttctggctttaagggagccacctaagagagtttgggtagacaggataatgaaaacagccctggtttctgggcttggttctttttatattgcttccttaaaatatgcagcatttacagccattgctttgtggctttattttttttaatccctcaactgagacatttagactagatgagtggctcatttcttttcccagaaaagtgtgcctatccacaaaattttgaggctacacagtcttcccaaacatcctctctccacctggagctttaggccatgggttagatcattttaaattacttcagctctaacattctacagcctcagggaatatacagttttaaattgaacacaagcttcagaaagagtgatcgttattatgagaagcagaacacagtgattacactttgactctggagccagaccaccttagttcaaattttagcccctttatttacataatgcagggccttgggtaagttacttaaccactctgtgctttagtttcctcgtctgtaaaatggagaaaataatagtaatcactgtaaatagtagtcactaaaaaataaaggttgttatgaaggttaaatgggtgtatacatattaagctcttacagcatacctcttaatgaatgtgagggattactatgtttcttactagttaagatgaagtatctcagcacagagatgaacacaccacctatctcgctatgaacacaccatctactccctatgaaaaatcctgtttatattttggtcgtggctgaaatatcaactttttccatgtgaacctgtaatcgggtccattattctgccataaagtagtagttatgagtgttgctatatacaggatgttttgggaaagatttcctgattttggccgggcgcagtggctcacacctgtaatcccagcactttgggaggctgaggcaggcggatcactcgaggtcaggaattcaacaccagcctggccaacatggtgaaacctcgtctctactaaaaatacaaaaattagccaggcgtggtggcgggcacctgtagtcccagctactcaggaggctgaggcaggaaaacagcttgaatccaggaggtggaggttgcagtgagccgagattgcgccattgcactccaacctgggcagcagagcaagactccatctcaaaaaaaaaaaaaaaaaaagatttcctgattctattgccttaatttggggctgttattaagaatctcttatcagatcctcagtagaggagatgattaaattaaaccaggggttaacttgatccaagctaggcaattattttttcatattttccttgtttttgtaaagtctttttgctatgcatgtgtatataatctgtgacctagggacaactactttctttgaaaaccataataacatgataagtataaaattatgtatttacttaacaatacaaagcatatatcattttccttgagtggcaaagttgaggaattaattaaaaacaaatagtagtttgataatttagtgtataaatatcaactgtcaattagaaaacaaaacacaaaacaatcactgcatacagtttcaggtaagacttatagtttgctatgcctttattctcattggtagaaagcattttaatgatttactcatggtcacagaggaagtgtatccaagttacaattaaatttcaaaatattgaactagcttatatagagccaattttatcttgaatttaaaaacagttgtatagaatagagtcacataaagtatcaaagattgccttggttgtatatggaagataaaagccaggttcttacacttaaaagaaatgttgatttatgttgaatttcaaaagaaatgattagattatccctgttgcctagttagcacaattgtctcagtgctctgaccttggtttgttaaaaaaaagaaaaaagaaaagaaaacagtgctttcctagggaaccagggactctctcaatacttaccatgtttatatttttacatgaaatttaatattttgaaaatgtatgaacccaacatgactactctgtctacaggttttatgttggactgttgccatctgtggttgtgaagccaagtgttctgctggggcagaataatcaaatcaaagttaatggggtgaccatctaagcagggctctttgtcattaaggtccactcttgtgatagtagcacattatcctgctgattggatttgtaggaaggcatccacctgtggcccacattggcagagaggagacttactgcagaggcagccctggcgaaggagaagcaggaggtagccgccctgggcagcagattcttttgctgaaaagccaaagcgtgcaggacagcataagcaatattagtagatgggtgattgacatagtatttggttgatttaggtcccaaagtaaagtaaccaaaggcagaggattagaaactgtatcattagagaggaatgacttgtcttgagcagggaaaaaacaactacatgtagagacactgagccagctgatcagacaaaatttaagcacgtggggccctttacctccatctcaggagtgatttttctctgtttggacgagagctattgtaagaatttccatgtctgttgggggcacagaggttctcacagactatggtaaacatgatttggctcacacgctctcataatcaggctgacttgcactgaaacagagagtgctctatagcggtgccaggcctctagcagtaccaactgttaaataataaacaggccctgtttgttggcagcctcttcccctcctgccaacatggagtgcccattttctgggtttacctgcccgcatgtgttcagacactcagaacagtgtgtgtgttgtgtgagttggtggtggcatggaggcatcagtctacatctaatctgcttagtttattattctctcaggacctcgggtgagctagcaaacacgcggggctctggcagcacgaacaatggctatgctgtcattctagataatattacaggctttgcagagtgcatcagctaattgtttttcttatgttcatttttgtttcttcaaattctctctcttcctttgagctggtttgtaggaagtggggattaggaggcataagagtggttctgtcaattagatgcattacttcctgaaagctagaaagtatttgggttgttggattttaatgcagtatgtatatagttaattcacattgatagtgagccacgcattcagtcaatcaacaagtgcttactgaaggcccacagggtgcaaagaaccctggactaagtgcttaaacttgactccatgtgccttactgtgttattgcacaagtgctggagtaaggttggagttttcccagattccaggtacccaatgactacagtagattatgaaagagcagttcaggtgagagccaagctagaaacacacacatgcaaacctcagaaaaaaaaggattcccaaaagtcctctattttgtcatggagacttttttctccatttcactggtcccacgaaaaggcccttgataatctgagttttatattgcatttttggccaaaggaatttcatatgtttcacagatgaaataattaaaaatagactctcttaattcctataaaccctcttcatcccccaccctcccagtaaagcccaggataaataggccgtgttaccatttccaggaggcttttggttgatcagtgtaaatgaggcatattcaaagttggtgatcagggatatgtagtgttaggtggggagggtaactatgaagcatgtagtgtttctttttttttttttctcatgaaccaattctaaaggtaaggtcccaaatctgaagtaatgacggtatccctggagtgactttcttccaaggtgaccattgtgaaaaatagcccttgtgagaagcctatagatttgtttaaaaaattagtccgattcctttataatcatggctcacacatgatgaagctattaattggttgtggtactaaaaccatttgcttgagtgaaatgaaacttctcctctctcagatcactaaatatactttaactgtggagtaatcattccgtttcttggactaagatatttttagatcaagagtaaatatttgaagtaagaactctggtgacagcgctgggagtgtttcagaaagttaggatggtaatctcatattcagtctaattttccctgaattcatgcctcaacagtgtgtaatgaatacacttatggtggagtcattttccttttatgagaaatgcaaggccccatcttcttattatcttttaagaaagatttctctggtttatagtgtcagaagtggttttaaaaatccaggcagtattgaattcacacagaatggttcagaaaagcctggtagtaaaattcatagagaaacaattgtttaaaatgcaactagcattgtatagcaaaataatgaatttgtattctctactagtctcctgttggatccatatcctcttgtcattgagttctcaaaggtttcatccaaaagaactaggctcagattgattacccttcatccaagcaattttgcctgtttgcactaggcctcctcctaactagcaggtctcagtgccctcaccaggacactccccagattggctctaggagagctctcatttctccctgtgtcaggctgcttgcagctagcatcaaacacaagctcacctatgctctcgagttttcagcatttagtctgttgtggatggaaaagtagatatcaaactctttagaattgtatctaaaaagaataaagagcctttgagtgagggcctgaggagcaagctctctgaggaggaaagctcatcagtatggtgaattctctcagctgcttgaccgctttgtcttcagtgttccagtgaattgcattttgatttcatacacatgcatacaaacacacagacacacacattatataggtatatgtaggtgtgtatacaaccctattatactctctataatgtgtatgtctctaacatacatatctcttgtgtgtttatctaaccacctatctatatctctggtaattgtcattgttcccagtgatttagacattaaaatctatgaaaataagcagcatcttttgagtacctatttaagcacccacatacctggaagtcctcaaggtgcttataaatttccactagactcttaattcatatggtcaagacaagtgcagttgagcaccaatgtagcatattaccttattactcattaaaaaatcactgcccaatttagtgtttcgcataatataagaatgtatttgttgtatataatagaaaatatgtatataattacaattgacattggttgttggtaaaatgggattgctggaatagcgcttaaacaaaacaaatagtactgacctattagaaaaattaattatgaaagaaaagtaatggattatagttgcagataatggttttggggacactgctggttgaaattcatcctgaggcttatttacaattggcacaattagagcttttgagaattcagcagccttgatttatttgcaggggttcatatagcacttgagtcacgggcgaggtgaggcacagaggtgggtaggggacttactgctttacatttaagttctatggaatttcacatttctattttggggaagaaaggattgtctctagagagagagcatcaggttctttaacaagatttaataaatttgggtccttgtatcgatcaaacttcatactagatcagataacaaaaaattgaatatggctttgcactagaggctattttattttctgtgctgccaatgaactaagtttctataattttgctttcactatttgaaattttaatttatccatcagatgtttattgatacctaatgtgtattcagtactttactagccacttgggatccatcagtgaaaagataagtaactcatgtagtatgttaggagatgattagtgcacaattcatttatgaatgacccataaaagaataagttgataaattagatttcatgaaaattaaaaaattctgcactttgaaaacattattaagaaaatgaaaaggtaagccacagactgtaagaaaatatttgcaaagaatatatctgataaagaacttatatccagaaaatacaaagaacttcgaaaactcaataatatacaacatattatttaaatgggcaaagatttgatcaggcacttcaccaaaaaaaaaaaaaaaagaaaaagaaaaagatggtatatgatgagcacatgaaatgatgctcaatatcaatcattgttagaagaaggcaaattaaaatcatgagacactattacacatcctttagaatgactgacatttaaaagactgagcatagcaagatttttgaggatatggagaaactggaagcctcataagttgctggcagtaaagtaaaatggtacagccactttagagacagtctgacagtttttaaaaagttaaatgtatgtttaccatgttatccagccatttcatgcctacatgtttacacaagagaaatgaaagttttttttttttttttttttttttttttttttgagacagggacttgctctgtcaaccagcctggagtgcagtggcatgatcatagctcactgtaacctcaaactcctgggctcaagtgatcctcctgcctcagccttcccagtagctgggactgtaggtatgcaccaccactctcagctaatatatatatatatatatatatatatatatatatatatatatttactccagtaattttcttatgcaaccatagatctattttccatcactacacagtagcttacatttcctagaattttataaaaatttgaattctattataaaaatagaatcttctgtacttgttttgtccttctttcactcagtatattgactttgagatccatttatgtcatagcatgtatcaataattcaccatttttttcgctgcatagtattccactgtatagacatactataatttgtttatccattcacttaaggatgggcatttagactgtttacaatttttagcaatacaaataaagtagcaatgagcatctgtgcacaagtctttataaaaatatggccatgtgcggtggctcacgcctgtaatcccagcactttgggaggccaaggggggtggatcacctgaggttaggagttcaagaccagcctggctaacacggtgaaaccttgtctctactcaaaatacaaaaaaaaaaaaaaattagccgggtgtgatggcaggcacctgtagtcccagatactcaggaggctgaggcaggagaatcacttgaacctgggaggcagaggttgcagtgagccaagattgtgccactacactccagcctgggcgacagagtgagactccgtctcaaaaaaaaatatatatatatatgcttggctggccatgggggcttatgcctgtaatcccagagctttaggaggctgaggtgggaggatcacttgaggccaggaatttgaggccaacctgggcaacatagtgaaacaccatctgtaaaatatatgtatacgtgtatatatattcaaggtagaataaatagatgctttggagccaactgaccagaatgaagacctagctccccatttactggcttgaaatcttgggcagatttgcgtaatttttcagatgatttttctctactgtataatggagataatataacttagagtcctgaaaaataaataagacaaggtacttatagttctttccttgccttcaaatctggactcagggggagatagattaagggcctgcctacatggtatgagttgagataggtgagagtaatgttttctcttatacttggatagtacttgtattagtctattttgacactgctataaagaactacctgagactgggcaatttataaagaaaagaggcttaattgactcacagttctgcacagctggggaggcctcaggaaacttataatcatggcagaaggtgaaggggaagcaaggcacgtcttacatggcggcagaaggacagaaaaagagagagaagagagagactgccaaataactttaaaagcatcaaatcttatgagacctcacttactatcacagaagagcatggggaaaatcgccccccttgctccaatcaccttccaccaggtccctgggattacaattcaaggtaagatttggttggggacacagagccaaaccatatcagtactagtgcaggaattccacagtttgaggagattcattctttttggatcaaatgttgcaaattctgggatttcttttttgaaaaatacaagaggatggcacactaacctatacgtttccattacaattttctaaattcgttggttgaatcagttttcctccttgcaacagtggccaagacagtcaacttcaaccattttttagatcttagttgaaatattacttattctaagaagtgttccttaacctcttcagtgtaggttaggtatgcccttggtgtctcctggttctacactcctctttcttaacttttagtgcattggttcttatgtctgccattttactactgtgtaagctccgtgaaggtagagacttggtgtggcttgttaatttccatatccacaaattatcttaataactaattattgagtaaatgaacaaaagtttttaaagaaggggtaaggtagagatgagggaggttggaagctctaagaaacagttctgccactctcgagttttgcctcaggttagcccttctgtcctttcatcagttccagatggagaaaatttttaatataatataatgcaaaaaaacttcacccctctaaaatgacacctaggcaacagtccaggctaacaacaaagaagaagctataaggagctaatccttgggagtagagtaatggcatggaaagaaaactaatctggaaataaagagatccatgacctcaagcctaacctcttgaaacctagattatttttatcttcaagaagtcctgttgcccaccctgcttatcttataattttgtttgagagtcaaaagagagaagagaagtgtgagccctgaattgctgtagaaagtgagaacttactatgaagggggttgtataaagtctcattagaggcagccttgctagtcttacttaacctttgcagtactaaagttgatgttctctgaactctctcttaggctctctcctcacattgggcagtcctcccaggcaatctcattttctcccataggtttcattagcatctgcatctgaatgaccaccacatatttctccagctcaggcttctctctgagcactgccttctagacctcttctcttggatgactcacagacacctcatactcaacatgttctaaactcacctctttgccccaaacatgctctcacctccagtattgctacataattgccgacattagaaacttgacattaccttttccatatcctgtactgttccacatgcagtcaatcacctggtacttttgatcttcctcctaagaatgtccttaatctgttcaatcttcttcatatcagaactactactctcatccagggtaccatcttatctcacctaagttattgcaacagtattctgacttccttaatattaatcttccagcctggctcctgtctcattttctagactgattcatgcccctttccccctagcattctatgctctagtcatactaaacgtgttttcatgccttcggtgcaccatgctcactctcatttctggtctttgcatatgttctactctttgttttgaatactcttcattactcttttcttcccccatgtgctcacctccactgacataaaaccaatcttgcaagtctcaatttaaagcttattttctatggaatgccttccccgattccctaattataattgccttacattgcattcctgtaatgtgcactttattatcattgattgttttgcctaaattatccttaaggtagggagtagtatgtcttattcaaggctgcgtctttagtgcctaacacaatgcctgacatttactaggcatttaataatgcttgttgagtgaatgaataaaaaataaattacaatagctacaaatgatattatagctaatttattacatattttactttttaaaatttttaatttttttcaaaagtttgttgctagaaaagtaagaaagatcggttcttgaaaatttattttactttcatttatgcattttgaatagctctcactagagcctcaatttagtattaaggagttattccagaataagagatacctaaactgcatgattcctatattcttcctctataaaattattgtgagaactacttttttttgtctgttttaatgtcagggataggaaggtatcaatggtgggtatgaatttgactactctgtcctagaaattattatgcccttgtcaattttctgagactaacatttaggagaattctgtgatcacaattttgactctatatctgacttaagctcaagctagacgcaaacattttctactaatactctggctttttcattatttctctattagaaactatggaagatattacagatgagacagtaaaagaacagactgaatatggttccactgacaaccaggaaagttatttgaaatgacatgaatagtcaggttgtaataaaggtttgttaaaacatttggtattgtacaactagtttccacattaatcaatcccatatgttctaattaataccttgctaaaatgtatgttgattttcaaggaaaacaacagtttttaacgtctgtagacatgttgcacatgcgtgaatttatcattaacaggttaattgagtactgaattgagcagaaataacatatcacacagcgaccctgcaagggaaacttaccatcattttactaaagaagaacctgaagatagagatataaagtaacttgttcaaagacacacaattagtatagagaaaccccaggtctaaacctaaatctgtctcactcaaaatgtttttttttactacattgcattacctctctggaaaacataattacttgttctgggtgtattaatttactagggttgccattagaaattagcacaaacttgatggcctaaaacagcttaaatttagtctttcccagaattggaagccagaagtctgaaatcaaggtgttggcagggctacactttctcagaagactctaagtgagggggaatcattccttgcttttccagcttctggtggctccagaggttccttggcttgtggctatgtaactccagtttgtgcctctgtcttcacatggccttctgctctctctgtcttctcttttttctcttataagaaaatgttattggatttacggcttccctgggcaatccaggattacctcatctagaaatccttaacctcattacatctgcacagatcctttttccaaataaggtcacattctcaggtttcaggggttagaatgtgggcgtttcttttggaaggtcaccattagatccaccacactggatattgcagaaattgttttgagagattcctctattatagatatatctgagatttcctttctttctctctccctttctttctctttctttctctctctctttctttctttctttctttctttctttctttctttctttctttctttctttctttctttcagacaggctctcactctgtcacccaggctgcagggtggagtgcagtggtgtgatctcagcttgctgcagccttgacctcctgcacgcaagtgatcctcccacttcagcctcccaagtagctgggaccataggcgcacaccaacacaccaagcacagttttgtattttttgtcgaaatggggttttggcacattgccaaagctggtcttgaactcttgagctcaaacaatctgcccactttggcctcccaaagtgctgggattataggcatgagacagcgaggcaagcctatctttgaactatttaatggtcaaagttttgctaatgtatatacagggaggaaaatggctggttcatgctgattctccatcagggctatcagtaaaagagtgagtgacactgtaattaatagaacaggaatgataacatcttataggggtgctgttcctgcttttggaatggcttctttaaatgtgggatgcatctaccccatttggttgtaaatggaaacatcagtaaataagtttaaagacatccttgtttgcctctctgatggcaaactccaatccatacatccactacagtctattttggtatatcttctatgaatttctccaacttcttacttaagttttgctaccttccaaggcaggcattaaaaaaaaatatggaatagtgctttattacctgaccctatttgtacttttctgaatatgaagtttgacctctagtattactattctaggatttcatgaataattctatgactaccctctgcctaaatttcataaccccattacatattagatcagggttcagtgccctgtcttcttttaacttttcagagactttccccccccagtcacaccatggatcttcaattccagggctctacacatctctctccctttaggccctcatgattgtggagattgcaaatgcatcattatgtccattcgaagatgtcaaaactttacataaatatatggaaagctttctagcctattttcagtacacttgatgagttccaaaattttattagtctttttggttacagtctcatatttaagctaatataattaggaaacaattgaaagtggttcttaaattcttttttgagttaaacctgatgtatcaaataccatcattataaaaacatgatttgtgttattttccctaaaaatgcttcccttgcatttatacttattaagaatagataatagctaacatctatccactgcctttgattcatgaggccctcacgaattgcctcattaggtctccgacagtatggtacaactactctttatattttacagatgaagaaactgaggctgtactgctactttctgcttacacatcctaatgaaaccttcctactggggtgatctcttttggtttgaatgtcactacttgagtgagattttattcactactttttcttgatcattggcaaaatgtccaatggaactaattcatgagagagtcattttttaaattaatttgtttactgaaagtccgaaatttttctgaacactaagaatgtactggtaagcaattataataggcagcttctaagatggccccacctgatctccacatcctctattttcacctgcttgtctaatttcctctcctttagtattggctggacttagtgactcatttttaataaaggacagaagtgataggatgtcacttccaaggttaagtttttaaaaagcttgtggtttttctcttgagtccctctatcactctctcccggattgctctccctgagaaaaagcaaagtccaagtcatgaagtagccctgtgtgaagacccctgtgtgaagaccttcacatgtgaagacccccacatggcaagtctcctcctcttcagtcgagaattcagatgaaaccacagctctagctgacagtttgatcacaacctcatgagaaactttgacccataggcacctacctatactgagcccagattcctgacccacagaaactgtggaatggtgtttgcttttttaagttactaagtttgggggtaagttgttatgctgtaatagataactaacacatccaagaacctcatcctcatggaatttatactgtaatagagattatgaacatacaggtacatgtgcatactcacatacatacaggatgtaaataaggaagatactagtaattagttctaagagaaaagtaaagcagggtagaatgaattggggatgctttggctatcttggccacacaaggaaagacctttctgtggagataatatttgagctacgagtgaagaaatcagtcatgcagagatgtaggaacagagcagtctgggcagaggcaatatagctagaccagggctaataggaataagattggcttgttttagagacagaataggcaaagaagcacggtgaacaaaggaaaaatgttagaagatgagaacagaaagatggtcatgaacagataatggagagacttactggtcatggttttgaattttaatttcttcttattgcactatatataacttgtagaattttaccaaaggaatgatatcatctttcctgcatttcaagaattctagcttctgtttagataatggattataaggtgcaacagtggaagcagagaaatcagttaggagaccagataagagataattgtgatttttgttcgtgatagcagagatagtgaggaatggtcgggtttgggatgtacttttgtgtttgggttaatgcggcttattgatggattagatgtggtgggtgaggcaaaaagagttgctgatgtttggcctgatcaactgtcagggcagatggtggcacctttcactgagacgagagaagtacagttagattagaggaggaagtggcaacatggataatagggaaaccagagttctgtttggggcataaattagtttacagtatgtagaactaacaagaaaagtgctcattattgctattctatgttttaagccagttcttgctttggaaaaccatttccaacatcttgtagcatcttgtttccatatacttccattttttaaaatctttgtggtggaattttttcagaggctatttgagaatttgtaagtaatatatactgactcccacttttcaatatagcaagttaatcagacaaaatatctcttatagaatgctagaaaatccactgaggaaaaagtcagtgtagtattttgattataatttattaaaacacacatatcaaatacaagataacctttggcctttccttgagtcagactttgttatagcttctaatcatgtcttgccctattcattagcagctcattcatttcccttatgccacctcactcaccttaaaatttaagttttagcagctttgctgtaagtcttataagtgcagtggggcatttgaatggatcgttgtttcccttcttctagaaactctgcagtgagaataagtagtaagaataattgtggctacataggtgcatttgttccctaagacaaagtgatcagagaactccaggggaaatgctattaataccaatattgttttgtaatgaaagggttaacagctgtcaaactcaatgtcttaaagatttacaaaaaaagaaaaaaaatgtcatctaggctgggcaaacatcagtgcctggcatgaggaattagcaaaaaggtctttaggtatctatggactaccaaatatgcatgattctctagtccactagaaaatttagaactgattctcaaatactaaaatatgaaactgaggggcttatacttgatctgctaattctgaaccaatgtattgcaactactgtgcattttgagatactattatgaactggcgtattataaaattaaattgtattgtatagttcattgtattgttccatcagattttgatatcctcactttaaataattcatgggaagaaatgatcacttcataatgccacaaactcacagcaggcaaaactaattttacacaatatgaaaacagattttatttatttaaaaggaatattaaaaaaacaacttttttgacaccagctgctgggaaataaatagaatactttatgacaaaaaaaaatccaaatctataaaagctcttcctgggagatcaagttgagaattgtaaagatacatttaaattccctagtcaatgctataagccttattttgagggaaaaagaactctcccatctgcttactctgtggggataaagcgatactgggagaaaattgactttacaaaagccctcctgaaacctttagcaagctttaggtgtcacttcagagaccccctattagtataaataacatcagtgggtaaacagtagctggtgtccttaaatacaaagtagaaattattgtttagctttgtcctaaccagaccttgattagaagtgggaaagagtattttggggtgaccacaacaactttcctttcactgtggctttaagaatggaatgagaaaatacggtgaaaatataatgaaactgttttctttgggagagtttattagatgaatattttaatacaaatataacatattttaataccaaagataaaaaaaatccaggctttcttttcaatgtgataacgactccatatctaactcaatcagacacttgcttcagacaaagaacgggactcttgccatgggcgggtctgggtttaatctcaggagcgtgagggtccaggcatccagacagtttgcagccctcttccctgaggcttcagggagagagagaacaagggtggaaaggtgcaaggattggagcaaaggagctaagaggtggatggaaaagagaaaaaagaacagcctaaaataaaatattttagcaccaaagcaatgaaaatacattctgtggataatgtaaatgctatttattgaatttttacttttcaaaaatgtttaacttaaaaattcttgctgacagtgggaatgtaaatctaagactaagagacgaacttaccagaagaagtttattattgtctgataacagctgaattccggtcttctttgggtactgtaaaatggggcagatttgtatatctgtgatgtcataggcactgttggaagggcttgtctctggttttgtcataagtttcctacttgagcagttataagccatgaattagaaattcattttagattttgaagagttacaaatttggaaggatctaagttaggctctattattctttaactttttaagatataaaatattaatacagtgtagcagagatttaaaatttttaataggtattaccaaactgcttcatagcattggtcttttcagtagctatttgtattttctaaggcaatagcaatatacacagaaaatgggttttctttgtccttactatatcagtgcaatctaatacgtacattagttagtgagattgctttgggaaaaatagaaagaacattgagattctaaaacaggatgtctatgttcaaagtctggctgaatttcacttactacttgttgaacttgtacaacttattttaacctttccttgccttatttttaaaattttgcaaaatggtgttaatattacctatctataagaccctcggccaggtgcagtggcttatgcctgtaatcacagtacttgggagaccaaggagaggattgcttgagctcagaagtttaagaccagtctgacaacatagtgagaacctgtatctcaaaaaaaaaaaaaaaaaaaaattagctaggtgtagtggtatgcatctgtggtcccagctactcagaaggctggggcaggaggattacttgagtccaggaggtagagactgtagtgtaccaagatcacaccattgcactccagcctaggtgatagagtgaaaccatatctaaaaaaaaataaacaataaaaaaaattctcttgttactcactgaaataatggaagagtttctgggataagcttagagagccataaaaatgttgatttaatcctattaataaatagtatataagttatgttcttcaaaggcatttgtattttaaagtatttaaagtgttgcagttgtattgttgcattttaagggatgactgtacagatgctatgtaatatgtgtaaaagttactctctttcttctgagtgttttgctgtaatacaaccagagttataatgcaaacatttaccaaaacaacgctggtatagcaatgttagtattcggcaacctgagttgtactgtaataacttttcaataaatcaaaatatgtgaaccagactattttcttatgtatagaagagatatgttattttagaatcctatttaaaatataagaaatgaatcaaaaacttccaaaattttaatttctttgatttttctaggatttctaccttctagaatataaagctcttattctttttactgaaatcttagctttacttcagcatcaagctgcttcataatgcaagggctaacagttaaaatgagagttaaatatcatttaaagagaattatttaacggccgtgttactgttatgaaattgtacatgttccaaaataagtctagtcaccttcacacctacttagactgattccataagtcaatcaccaaacacaaaattttggcctaaaatattcgttaatatttatgtactaacaggaatgttcacgtctaagcgggagaagccaggttcactcaattcacaaatttagtatctaagatttgaaatatcatagctttttgtgcatttaaaaaaattagacttacatattgactttgagcctagagaattttagaaatagaaaatataacgtttcatagcttttagatttacaaggacatcatttttatttatagaataatgcattgtgcttaattacaaaatatcaaagtttttgtcattagtgaatttagagtggctgtccccttgttcccttgtggaatttactttgttagaatagattgccacattctttgaagacaattgccttgatactgataccagtcaccatgccttcactagatctggggatggacaataaagtatatgaggagtactggcatactaagtcataataaaattagctaaatgttctatatatcaaagaatgaggtgattttggtaggtaaaaggtagtccaacctgcacttctgttgaaaaaaaatgactgttgtatcaacctggtattccatccaaacctgaatttgagtttatccaaagagctgcactgaaattcagcaagatagcatggactgggccaggtgttgcaggcagaggacaggattttactggcttggcagagtaggactttaggttatttcctccaaagtgacattaaattcctctctgtgctatcacaacaccttttgttttttcagacctgtctatagactctcagaggcttattctgtttcgtgaaaacaatgcagataagctgattgaaatgtcaacagatataaacatgcagataaaatgttagtatgtaatggtagttttcaaacataatgagtaatgaaatttaagcagggtccaggtggaataggatcctagaatcctagaataaaaacatatcattttagaggcagaggtacagtcccattcctctgtttaaaaagatgaggtagataaagtccaagatctttcatctggagtgtttgaaagagttgggactagaagcacatctctggtctccagtcaagtgccttttctagttgagcttgacttctttatatctggataataaaatcaatctcatacaatgatataggtcatatttttccaaggcagttaagtattcattcactcctataccatcaataataatgacaaacatttatataaagcttacaacctaggcagtaccctaattgctgcctagcaggctgtaagcgctatatgaatattgctgtatgaatgttgcctgacgtgaagagttagacactgtagagtaattttccttatattgccttttgcttaatattgcccctcttttaaatcttcacaagagccacattaactaggtactgttgtcctcatttcatagttgaaggaggaaactgaagcacagagactttaaatatattcaccaaggaaatcgagccattaattggtaaagcctggatttgaacccaggcagtctgggtttctgagcttgcgcccttatccactatactgtgtattgttccaataatttttagttgcataaacgcttagaaatagcatttataagttctctgtgctccagaagaaccagtttcaagaaagaataaaatatatgtaaatagcggataaacccattatattttaaaaaggttggaggcactggatactaaaaaaaaaaaaaaaaaaaaaaaaaaagaagaaagaaaccataagagaaatatgataggtatggggggaagggattttaattgttctcaatgactgtagagcaaagttagatccaataggtaggaattgcaggagataaatccgggcttaatatggcagtgcagtgaccagaataggcaaccttgttagtgagccccctatctttttgtattcaggctgtgtgactggtccctattgctacagacaggattgctgcactggaatagtacatttggagcgcaattatgctcagttaggtcagaggtaagagacgtcattaaatttcatctgaaattatattgtaaaatatgtaagggcaagagctccagacagatctgactttgaatcctggcacgatcacttatttgctgcaagaatttagtcaagttacttaactctaacttctctgagtcccagtttcctcatccatgattgggataattgtactaatctcctagagttgtggtgaggaggagtaaataagatcattatctaaaatgcctagcactgtgccaggcacataataagtgctcagggtatattaaatttttcaggagtgagagactcattaatttttcaaaaatgaactacagtcctaattattctcttatttgggaaaggaagcttggcttagcaggtaataggactttatgctcaccaagctctcattgcctttggataaggaaccatgaaccctggatagtgaaaagtccttgtaaaggaagctttataaatcaacttatttaaaatgcaatagagcagcttatgatttaaaagcatcctgtggtgaatccttttaaaatgtgaataatcaccccataatttgtctgtttggtaagttcagaatttggcttattgtgtcttcttaaagcaaagagtacacctgcactcttatttcagtattttcatgctgggctgactttcagagaaatacagggtgcctcttggattcaggatggcataggttagggaacggatgaaacatgcaaggtccctaaagtcagtgagaacattaattgtactttgtgatgcatacattttaatgagtatgaaaactcatagagatcagttgacctagactgtatcgaggatcattgcacataggaatgctgtctgacttgaagagttagacaatgaagagtaatttttcttatactgccttctttttctctgaaatttcaaggaaagtcaacatgaaattttgacatgatatacagatcctttatgaaaaaccaagcagcactggaaacctttgcagtagaaagaacactagattaggaactggggactctgagtaagacctgccatatgctaactgcatggcatgggatagcacgccacttttattctttctttgtcttagtgttctaattgtaaaataatgaagttatacttgcatctcccgtgtaacttctacctagaatctttagtgagctgattcataaaaccaggtgtgaaattactttgtttcattctctccaatagaaaaattagaacaggaaatagtagaaacagtacttaagaggttattttctattggcaatacttgttactctgccttagcttgaactctcttttgcctatatgaagatttatgaaacattttatttagctgtgatacagagattaatataaacgtgggaaactcagactaaatgttttcttttttcctatcagctggcaaacattgacctgtgtttgaagaaacttgaatatatttgagagaaaatgacctctcccacaaattaattaaatctgagactaaaataattatatctcttcattgattccctttattttcacagtatccatgggaattttgccagttcttcatagagtgatttaagcttattgacaacccacttggatgaaatacagtttgaatatatgctggtgactctgtcctttgcaagttgaattggggaataacatacatcagataggatacttaaggagccctttttgagaagcaccatacagtttaagagcccaggtgactgctttataagagatctgagaccactttaaagatccccaatttttcacactggttgcaatccatgcaggatgttgaaaggagctagaatccataagtgaccaggcttatctttttatcaaataggcatttaaaacacatctttatgcagattcatatattgtaaagggctactattcaggacccaaatttctaatttgtcaaaagcctcaagctgattttaagagaaacttaaacttaattcaattaaggaataatgaaactgtaagtttagccaaattggaagtgccttcaaagacttagcattccatagtcaacctcagaattttactgtcaaccctaaagatgctaaaactattgagttttcaattatgtgtgataagaacatcaccctgcataatggctagtagccataattctttacatcctgaaagtgaagaagaattttactgagtcactcattgcaattcttaagaaaatcactatgcattgatatatgccattgccaatattttaatgtagaaataaataaccttcttaatcttctaataaacaaatagaaacattaaaaagttaatcacataacaaaacaatttccatgtttcattttctcttaaaaacgtagcaaaaatggaaagtatataaaaagcgattatcattagaaataaacagaataagtcattaaacgtgaattccagaaaggtgaaactgcatttatagaaaaaatttcaaacatatggtgtagagattaaaatttaattatatgtcatcctgttggaacgtgttataaaaatatgtatgtgcaataaagggtcaagaaatatttattcagtacttacttggtgctcaatatttgatgtcatgagacatatgaataatacatatataaataattgaaatttattctatttgacaatcagactttctctacagatcttatggaataataattcttccaataggtatataaattatgaacctattataagattaaaatatgtttgtaaaacatatatttgcaaaaatagatttatcagttaatccccatttaatcttactttgatgtattaggaagtttctgtggttgtttaatagaatgtagacttttggagacctcttaagatctcttacctgtcttaaatttgtgaaactcacaagtgtactatcagtagaaacaaggaaattacacaggaaaataaaaaaccaggcccagggtctgctggagatatcttttaattctatattgaagtattggatatgggatccatgatggagtccaagttatactaggcagaatatattatctaagcaatacttggttcttattgaagaactgagaagtcatgaaagcccaagagcaccctctagtgaaatttctggagtaggcttaaggggcttgctcttgaccttagctctccccctcacatgacctttgatctcccaaaagatagcagttatatttctagaatttggctttatcatcaaatcatttccagatcacaaagaaggtgggctgcttgtcaagtattactactagtagatatgcttaagcgctaagacctactatttcattgttctcatgatttttgtttttgcttgcagtatcagcctaccgtgttaaaatagtttctggaactaatataactaacgaactaatgggaagcattacaagtgtgtagctgaattgtagtacctttgtcccggcctttacctttctcatgcctctgacttttggcttaagtacactatatacagaaactgtattaatacttgcaatattcgaggtcaggggtagcaggtgagatttccagtagaggtcaaaaattacaggaggagtaaaaagtcttagtattcatggacttctgagtttttagagagatgtttacaaagcaagcctgatcttagctataagttagttaaagctgtgagtataatactattcattttgattagcaactattatgtaatacatgaagcaaggcaaattattaattgactttatagataatttgctctaaaattatgattggtaaggaatttagagatctaaatcctcccactttagggaaaaaaacccttacgcacctaaatgttaagtagcttgctcagcatgacacaaatatagcatcagggctacaacatacataccttgttcaatatcctacaagaacctgcttattaaggaggtttcaatattctttcacaattttattcttattagttttttggttttttatggttctaataacttatagacatgtcttcatacttacaggaaaagaaaatatgtaacttccaaggtcatcttttttctatctctgctttcatgtaggaggcttaagtcactcttgtgattactattaagatgaagtaaaaaacataatgctttgatataaatcaaacattaattcttgaaacactgtgccacacagtgttcacgttgtgcactgaaaaaaagtggagggacccatatgtcagactgatattctagaattactgataaccacctctgagattctgtacttcaaaattgtttctgtttttattagtacctacttcctagtgttcatggaaggattcggtgaatgaatgctaataaagcatatggaacattgttggcattgattaattgttatactgaatgctgatgtctaatttgaaaaaggaacaagacattttggggattatccggtaggggtatgagctatgaactgtattaaattttgtggggggagattacagcctgatgtctttcttgggggaaaaaacctctaagatattcaagttgttgttttccattgaaaatgaatgtataaaaatgacgatttgggaagacatattacatattaggtcaaaagtgtatgattcatttctcaattcattactatactctcagtcttggctttaatctcaaccataccacctgtgaccttagtatacaacctttccttcattcatattattgttgatattcagaaggtgaggtggttgtttatggcaactaaaggcaaaattacagaattttgattgttggaaagttaataattcagtgatagttttattcccagttcttttcctactttgctattcctcaacatacagtgttggtatttagaatcttaaaactagaaaactttaatgctagaagtgatcatagatactgacaagtctgattcatttatcttacagttgaaaaaattaagaccccagcgaggaagaaaactggccaagtttaattctacatactgactttcagtgataggtcacatttccttatttttctaaaaataattgactctggagaaacaattgattccttaatactgcactgatgtgctgaaccaatagatttaccaacgtaaatcaatgttatctgtgaatagacagtacacagtattttaaacctatctattcagtagtacggtacactgccttttaattcctgtcgctttgcgatgatgctatagctcacaccgaaactcttaagtgattatctttaaggattttcttctccagctatgagtctaaacagtctgagtaaagaggctgcatggtctccccatggcctcctaaatgtttttaggaagtggaacccccttctggagttatgagagaaacatcacttctaaaatgcctttaaaagtactccagcattaacattacactggaacatttcattagctttttgagaacaataaagaaatgtggagcataataggctaatatgtttaagtggccttggtagaaccctacttaactcagtgggattttctgcagcatgcagaggtggaaaaccattccttacatatttattgtgtaggactgcctccttctttattgcatgcaatttatatcaaagagaagtgactttccacctgtaattctaaaatcaagcaagtctcaaaatacacaattagaagaatcaatgtttagatatgatgatcagcaaccagcagtgctgacttttggcactctgaatttctgtcagtaaagatggtagaggagccaacttgaatctcagtatttcctggccttttaggacttaaattttcatcagggtattaagatctatgaagtatctgagttcctaaagaaaatgtgcgatgtgagtcaaacctcattggtcacaaattacaaaaattaattcaattaataaaagttattctcttactagcaataaagctagctagaaaacttttctgcaaaatattttgcattaagtaaaaatataagctaatgaaaaatacaaagtggtagtttttatggttttattaggatttcaagtgagtatacttgctatattgctattcttgcagtataatattctgccagtactctttagctctctgagcttctattttctgtggtataaattgggactcattagtcttagggacactgtgatcattgtgatttgtttgagcttttaggaaaaaaggtgtaaattaggcccacaattacaatattttaagcaagttcaaacaaacatacatgatgacaaaataaaagtttccacatatatattagtttcctttctgccaacaagttgtcaccaaaatttattggaaagaccgaattcctgtttgtgtggcattgaattaatgatattaaaaaaagcctcttgagtgacagctggagtggctgaagtggcatatttaaaacattatgtttgtttgtttcacttactgtcaaactctgtcttagaaatactatcaactggttatattgatagatagaagctgtcttttagtttcaggatatgttttgtatcaaagtttctcttcattggtttttgggatctatatgcaaaataacatataaacacaaatgtaaaacccagctgtaattgtctcttagcatttgatgacatcataaattccttaagatttatgctcatgttgtattgtaaatatcaccagaaccacttagtatgagggtgaaaatgctaaacaaaacttattgaaaataatgcatatacttatttttcactttgaggagcgtttcctagctaccctatttaccccagtggaatttcacaaaaatgtccctggcactcaaagtttgtctaacaatgaatcaagtgggcttattttaaaattcacccctaaatatgtttgctggttttgaaattctgattttgtgcttatgtaattcaaaaacagctttggtttaaaaacaaaatttggcaaaaatactagtgcattatgtgttttaatcacgtatggtgttttgaaaaaaatagactcaaaattgacaaaattgttttattggcactacagttcaaatgcatggattttcttcctcacaagttgcgtaaaataaaaataaaatcagcagatatttcttaagtgagtagtatgtgaacttaattgatttttataaaatatagtacaacaactgcactgcaggcataaattttcacgctatgtttttgcatcctttattttacagatttcattatgttttatttgatggtcaagtctatagtgtgctttagcataagttttaaaatgcatggagctctcaaaaaagtttcttctagtgatatggatagtacataaaatctagtatcaatggcccagtgtttctctttcatagagttctttgattttttcttatattcttataagtcctttctttggaaaatatatgaacttagaaacagaagtttccctggctcatattatgcccatgagacaatgataatgctgaagtccttttcataatcaggacctttatagagatcatccaggtattcttagccaaaatatccctctcattgtacactactccagggcaacatgtggtgtgccagctggatgccctccctacatgcctcaggtggccacatttcaatggtgcctatagagcacaggccaaattctcattctctgtgttaatcagtgggagaattcccatagaaaatgggatgtgaacatatttcaggaaaactcaaagagattagccagatgattaggccaggacattgtaagttcaagttttatgtaggatttctatagcattatcttagttgaccgaagaatgctataaaatttggagatatttagaaattaaaaataatcatccttttcattttactgtgatttctccaaagagaaattcaacaatattttttcttttgatataataggatctcatcttgattcataacatcaaagacaacggatgtacctagtcatataatttgactgaaactttttcccatggtattaaaaggatctgattctacttgtagaagtctcattatacttctcttttcaattaaattctagtcaattctacaaacatttagtaaatgcttactatgtacaaagcactttaatagatgctctgaataattctgtgtatggtgctttatagtatgtaacatattttcacattcattttctcatttggtgaagattcactttcttattattacttaaattgtctagagtttcagatgatgttgtttcctaggtagaatgtttgttttgtttttgcttgttctatttttgatgtgtccagagaccattctagaaatacatttagctttccttgaaggaaaaataaggtcttatcattgtatcatcctattaaattgagttggattggaactagcggcatttcctgaaatttctgtttgtttcatatgccctcaggctccattttaagtgtttttttaatgacctaattgaaatggtttgtcaacatgttcaaaaaacaaaataattttatttactacttttatgacaatactgatttatcatatttcatgtaatatctttttaaggcaaaaacaattagatttttccagaaactatttatatctcatacttaagattatattaaattttactgctctaccttgaaatctgcaagtgccatacaacttctgtagaataggtatgaaatctattattccccatttagcatgtgcaatatgctctaatattgttgcatctaacgcagaatgaaataatctgcttctatattaatgttacactatcaagtcttatttctacatatttctgagatttttttcaagtctttctctcaaacctactttgtaaatacattagaatagccccagttttacttttattcattcattttatttcccttacccgtagtgttgaaatggaatttatcaatgctttagcattataagattttcaaataatttaaaagaaaaattatcttcactttaagcattgaatgcatcacttttttccataaacccgaaactcagaacctgtaggaacgccttcatttgctttatttctgacattaaatttgcaaaaaggcactttccaggtaacccatcagctatgtcaccctgggtatttggccagagggcagtcatgttgaccccatctgcaaaggctggctaaactagagtcttggactattagaatctcattcatcaaggtccacataaagtacggtaggtgggaagcaggaggacagatggtagggtcgggcgcaaggaacttgtttgttgacattgatgtagacgcttcttcttgccagagtgactccatgcacttattttggcatggaagactaggccaaagctatcatcttaatagaaggtgagctgcaggcaaactagagagatccatgcacagtaggtatttagagttggcttagattttatctatcagcttgactgtcatacatacttgattgatgtgcagcagggcttgaaagtgctgcattgatgttgaggactgtgtcataaggttcctgatatggtgcacatgtctgaatggagttggacattggctgtctttgcccatgccaaacaacaccagacttcagtgcattattctgcagttgagtagcagatggtgactgcagacgtttggagggggtgtgccttcaaacacaatatggagccagcaaacttacttagaaggttattacatgtcttgactttggcagctattttttaagcactgttgaaaatccaagttccatccattgttattcgcaaaatactaggcaaggttggtattccatggaaaagaaatgtgaaaacgcaaatacactgttcactatgctggttacagttacttgggggtgttttccttggtattgtctaaatgggccaagtaaacattctcagattgattattcctgaaattggtaccaaaacaattattaatattagcaatgtaggtaaattttatcaataagtcaacaacgggaaaggccatcagagcattgggtgaatgctgtagtcaaatatggtatttatgagtgactttattttctttgggttttaattcaggaaaattattgtgttcttcagcactaaaaaaaagtcaagtatctcaatatctcaatagatgttctttatgcacaaaagtatggagattcacagattaaagagcacagtaattctacatgtatatgaaagtgatttttatcggtatctgatttttttcccttaagtgaatttctaacccacataaattcattttaggcttaaaataacttttttttccagattaaaaggtaatgtacacttgttgaaaggatgtgtcaaaatagaaaatatatataacgaataaatttaaatcacttgacaccaccaatcatggataaacaattctaagtatttgctctgcctctttccaagtgtatgggtgtttctaaagtgtacaggtgtttatatatatgtgtttgtttgcatatttctaaacaacattttggattgtatagtctgtatagtgatctcttcacttagcattaattttattaattctgagtcataaaatactcattttcattagctgtgtaatattatatcttaattatgtaccaaaaaattttaattaactccttcatgtttgacatttaggtcattttccactattatttctcctactctgaggatcatttttatatataaatttttatctgcatcttggattatgtttttagcatacatccttagaaagttgatttctgggctagaggatgtaaaattctcaaggttcctttgagaattcttctccaattgtatgtaaaagtgcttttctaactacattcttaactgttttgaatagcagcattatataaatatatgacaaattgcaggcaaaataactagtttacatagttttaatttgcagtgatttaataaggaactagaatgttttttacatgtttgtcattgttttcttatttttataaattgtttgcttgtggtctttactcatgtagttttactgatttgtaagattttatgtgagaaaatgttaaatatttgtatggtcaatttcttgtgtatttttttctctgtgactatgttcattacttttatcttcttttttaaatagcttgaaatttagtaaatattcaccattttttctagtatgatcatggttctgttttatatttttaattgtgtttctcccagaatttattttagcatgttatgatgtaaacatcttacttacttttgttcttaatggttaatcaattgttccagaatcatttccccactgattttgacatcatcttgattgcctactaatttttatcaacattaggatctatttctggactatctgctttttcagttctttcaccggttctatattgcttccattagagcttcaaaataagtttgtgtatcttttaggtaaaatccttccttatctttcttttttcaaaaatgctttggcttttgtcacctacttactagtcaggatttgtttagtttgttgagttcataaaaatgtttcattggaatatttgttggaattgtattaaacctataaatcagtattagtatctttgcaatattcagtcttcccattcagaagcatagtatgttttcatacataaatagattgtatctttttattcatatagatccccaaattccttcatatatttaggtataggcatgctatgttcttgttagtgtccttaattgcctatatttcatttataattctttggtagaaaagccacttcctatttataatccacatgatcctcaacttatgtggggttccattctgataaacccactgtaaaactggaaaatcttaagctgaaccactgtaagttggggactatctgtatttattatctagttattttattcaactctcttaatagttttaataatttcttttaagttcttttggggtttcaaagttattaaattatctcctaacaaagatgactgtctatttcctttcttattcctgtttaatatcctatttcattgactataatttccaaaacagttaagtaatcgttgtggtagagggcatatttcttgttttttattatgtggtattatctctagttttttttcatatttaaggcagatattggttgttgatttaagacagatattatttgatatattggtaaagtggattaacatactattttctgaatccttatttgattattaggaatggacgttgacttttattaatcttttttttctggtaaatattgtccaattgtaactcatggacatagacttttcttgagatgtatttttcaactcaaattaattcatcatacattttatttagcacttactatatgccagaaattgttcactagacattgggattaagatgcatagccctttccctttaaaacattataggataatttgaaatgtgacagttcagcaaaggacttagcataattgattttccactatcaaattgctcttgcataactagaaaaaactttatgatcttattaagaaaactttcagagtttttttaataacctaatggtataacatgtcacaatgtgaatttttaaaattgtttaaatgtaaaatggtgattcacaattgaaattatgagtttttatattgaaacaccattgtgttcagattctaataaaaaatgtccataaaagtttataatgcctcagaaaattcatagacttatgtaatatagattgtttatattctgtaagattaggaaattggaatttctaatcacacctgaccacttcttgtagagtatgacaaaaacgatatgtgatattggggcaactcattttcatgatgctgtcattggggtttcatttctctggagtctgaatcatctgaggatttcagcatgtatttacatagatttattttcacttgaagggtttttttggtattaattttattggcttagtgtagtgtagcataatctaacttgctttccccatgtaatggtatcatttgtcttatttttgggaattctttaattttgttcttttacatagtgtgcatgaatgaaattagattttttgtatttcacacaaatatttattgagaaccaattttctgctcagtatcatgctagttattatgaattacaacacagaaaacataagtcatactttcaaggaacttactttctagttcatggatagatacaaataaggaaattgcaaaactcctaatgaaatatttatttttatagaggcatatatgtatgcctctgcatgtgtgtatatatagagagatatttatttatttatttatttatttatttatttatttatttatttttgagacagagtttctctctttttgcccaggctatagtgcaatagtgtgatctcagctcaccgcaacctccgcctcccaggttcaagtgattctcctgcctcagcttcctgagtagctcggattacaggcatgtgccaccatgcctggctaattttgtatttttagtagagacggggtttctccatgttggtcaggctggtcttaaactcctgacctcaggtgatccacccacctcagcctcccaaagtgctgggattacaggcgtaagccaccacgcccaatttattatgtgtgtgtgtgtgtgtgtgtgtgtgtgtgtgtgtgtgtataagttgtataaatatatttcatatagacttaatatagagagagatttatacacacacacacggagtcatattcttgttcttttagcaaatgtgtcagttcttacaagattccttttgtatatttacctcaccctgtcctcttcatgcttttcctatcattattgtacttttataattgtttcttcacttgcagcttaaataatatatttacttctgcaattttttttattgtcttggaaactacactggatagacaaatgtcatgcacattaatctgtaagatattatcagtgataatttgtctcaaacaaaggtgaacctgctcagagtttggaaataggaatagtgcaggctactataattgtagactgaaatcattgctttctgaatctcctatttgattaaagtacatacttgtcttgatttttagaactattcacaaagagttaacatgcatagtaggagaaacccaaaatgtgaatggcgaagttatcatctctattaaatggggattttagcagtaagctttggtatattaaggaagaaaactcccatactttgggctttcatgagatttttatttcataggcccattcattttaaactttagcatttggcatatattctaaggtttagtcttaaaattttatcaaattttgaaaatttctatctcccctaaatttttaatgtctgcattgaataatgtttgtcacagaccacaatacctgtccctgtggaatggttattctatcttaattcaaaagtaatactattgattagataatacttacagcttccaaacttcaaggcattttttagccaccatttctccttaacctaattctgagcttcctgtgtggtatcatttgtttgaggtcttattaaaatgtaaataaattgcacccagcatacttcctctatttgcccagcttattactatatcaaaacaatcgttttaatgaaacatattgatgtattgtgtatttccgtattaaccaaagtgaagaggaagttatatgaatatataacagagcccactttgtaacagtttttgttaaagcattttataaattggagataatctgagccatgggagatgatgtaattctacatgacagagttcacagaaagaggatagctcctcagatagaataagattagactcttgagagagatgcattggggcttttatggcactttacctttataggcgtagctgactctcagttcttcatattaatgttgtagtgttgtagcaaagatagtaaaaataaaaataaagaaaaagagtgttatctaaaataatgtatctttggcattgatatgaaatttttgacttttaagcatcaaatttgccatttcattttgttcatctagaagctacttctaacctccatattatttcggagaaatggtttaatatttatgtagtagccggtcgtgtgtgcgtgtgcgtgttttgtgtgtgtgtataaaatctccatatgacatgattgaataaaaccaaattcatgaagtaataagcaataacaatgagtagtatcatgaataatgatcaattgcagggctattaaatatgatagtacttgatcaattactaaattaattttatagaaaacaattgctatagaaatacttgaaatatttccgttgcttaagcacaataccaaatagtaaaaataggaggctactcgttgtgtgcaggggaaaatgggtaagccaaattgggattaaaatgtgtcacgttggaatgaaatcctgaaggtccagtagtggtttattgtctctgtgtcatcagactattgatgctcgtaatctttcctcatattttctatattttcagtgtactgttttattttgtttttgcaatgggcatgtattcatgtcatagtcacgaaaagttaatgtaaaaatgtgttatgtatagcctacctgtagataattcattaagacttaactactaatatataaaatctgcctgaaggaatgggagccagaagctaaatttaaaagaaaagtattttattgtacaaataatccatgtctccgaacttgttaacattctatttttaaagcattctttagtgcaagtcatggagacctaagctcatgaggttagtcattactaggaagttacctgaatatttatgttacatgtaacagctagagagccagctaatattaatacaattaattatattctgttagaagtactatagaaacatgttatagagggcctttcttatctcatatggagtttcaatacaacttagaaaaaagctgcctgttcggacacctttgtgcaaattattaaaagaaaccctttgctcaagcagatgcagcttgggctagggaacgtgggttattgagtgaaacacactcctggactaggtgccttggacagggtacaaactatataatcagttgtgtctgctctatgttatatgccttattagttatttgaaaatggttggtgttgttccataggtcccaaattattttattcgtgcacagaaaggcaagaatcatcttcaggtgacttagcaaagaggtggttagttaagctttaagttaatactgagctctgatgatacaaatatgttactttgtctcagacaagtttaaggcagatttgaggctattctgatttgaatagcttcgaaggtagaagaaaactaaagtcaccacaaaaacatagatgagtttatagaggatctaaggttgctattttcagattgcatctgaaatgttggggtatcatatagtaaatttagatgaattgttacatggaagggtagatagacaaatatacagtagagacagatagatatctctttgttacaaaaagaaattgagatagcttaaatgatacatacatgtacaatataaatatatttatgtataaatatatttatataaatataaatgacagtaagtgaaatatataatataaattaagtaaataaaaaataaaatgggtaaacagtggaaaaacatgagaaggaggcaagaatttgacctacatttaaaaagcatcctataaaggatcttacctacatttacagattgggctctgattatatattttaaagaaatacaatgcttatactaagaaaaatcaattttctaggatgctcttcagtatgtatagggatcactgtattataatgtaaatatcaagataaatattaactttcattagcaacaaaggatattttatagaaatgcttctttgtagtcctcaatgtagactgacaacatcttattactgtgaactttagtattcccatttttaaaagatttggaccaaatagagaacacttcacacagatataattcattgaatgacagtgaattctagattatctagattatattatattagattatctagattatattacttgaaatacaactattttttgttattgttattatttgagatggggtttcactctgtcacccaggctggagtgcagtggtgccatcttgactcactgcaacctccgcctcccaggctcaagctatcctcctgcctcagcctcccaagtagctgggactacaggtatgcgccaccatgcgcagctaatttttgcattttctgtacagacaggatttttctgtgttgcccaggctggtctcaaactcctggactcaagtgatctacccatctcagccttgcaaaatgctaggattacagatgtgagccaccatgcctagcctattttttttattgttaattaatagcagaaatagtaatgaagttgggacagggttgatatccttttatagaaattgcaaagcctaataaaaacaatcgctggagaggtttgctggaaaaataccattccacaggaacagaaatctgtttaaatatttattttgaatccactctaatgtatacacaataggtgttcgagacttcaagtttctttttcattgtagcctggatattgccctattgataaccttataagaggtgacagcgtgctggcagtcctcacagtcctggctgctctgggcgcctcctctgcctgggctcccactttggcggcactttaggagcccttcggcccgccgctgcactgtgagagcccctttctgggctggccaaggccggagccggctccctcagcttgcgaggaggtgtggagggagaggtgcgggcgggaaccggggctgcgcgcggtgcttgcgggcaagcgcgagtcccgggtgggcgtgggctagacggaccccgcactcggagcggccggcctgccccaccggccccgggcagtgaggggcttagcacctgggccagcagctgctgtgctcaatttctcgccgggccttagctgccttcccgcggggcagggctcgggacctgcagcccgccatgcctgagcctcccccgacctacgtgggctcctgtgcggcccgagcctcccctaggagcaccgccctctgctccacggcgcccagtcccatcgaccacccaagggctgaggagtgcgggcccacggcgacggactggcaggcagctccacctgcagcccgggtgcgggatccactgggtgaagccagctgggctcctaagtctggtggggacgtggagagcctttatgtctagctaagggattgtaagtacaccaatcgacactctatatctggctactctggtggggacttggagaaactatgtctagctcagggattgtaaatacaccaatcggcactctgtatctagctcaaggtttgtaaacacaccaatcagcaccctgtgtctagctcagggtttgtgaatgcaccagtcgacactctgtatctagctactctggtggggacttggagaacctttgtgtggacactctgtatccagctaatctggtggggatgtggagaacctttgtgtctagctcagggattgtaaacgcaccaatcagcaccctgtcaaaacagaccactcagctctaccaatcagcaggatgtgggtggcgccagataagagaatgaaagcaggctgccggagccagcagtggcaaccggctggggtccacttccacactgtggaagctttgttctttcactctttgcaataaatcttgctactgctcactctttgggtccacactgcctttatgagctgtaacactcaccgcaaaggtctgcagcttcactcctgagccagcgagaccacaaacccaccagaaggcagaaactccgaacacatccgaacatcagaaggaacaaactgcggagacgccgcctttaagaactgtaacactcaccgggagggtccgcggcttcattcttgaagtcagtgagaccaagaacccaccaattccggacacacttatacaacaaggtgacggagttccatcacattctccatcctcagacttacatctttaagcaatgtatgtgatgtttcaggattttgtttcatggattagatttcttgttttccagacagaaacagtaatctttactattacgggttcctagattaaaggttatgacactttaatgagatgaagtttggtgaatactttgatttcctcaacatgttgtaaaagtgaagtattatgttgatccaaagatatcagtaagatattcacaattaatgctttatacattctgaatttttcctaaacaaagtttgctgatttttttcatctatttaagtctctgaaggaaaatgagtttagataattcctagaagcagatactatatgtttatctcttttcatgtgataggagttattttgtaaatccgttcataatttaaatgctctagggaagtgtattctcaagggaactttattgtggatcatcatgtaaaggaaaaattattatatagtaaatattattctctatatccatatgggaactttctgatttacaagttatttgagttccaaaaggagcttattccctttgtgtgttcccaaggaagtataacctgagtgagcccaggaatctgtgagaaaataagctggcaaatactaacctgatccaagtaagtatttggacctgcttagatctctgagctattattgttttgtataagattaagtctaaatgacatattctttacaattgcttagaataggttagtccagctccaaagttcatagcaactcattattaaccaaagtaattctagtccttctcgctgagtggtttctccaaactctatagagtgaggcaaaactatttatctcccatgggagaattttggtaaccttatccctatatcccatacacttccctagaaattcttaatcccccccaaacctttaaactttctagagatgtagtaggaggggcagttgaagattttctatacacatgtaaccattatgaaaacgttcattcaatggcagttagacttcccccccgccaccccacatgcatggatacctgcagctaggcccctgattcctgcattactaagaaaagaattaggcagtggtcattcgctgaagaaatggcatatggcataagtcgtttatgcccactatagattaaaaggtcataaatcatatcacagaagctggatacttttgggagtgaaagtggccaaattaaaagttatgttgggacaactagcacagttaggagcccacagtgttttagccgggagtgcttcctcctattatccgtccccacagttccattgtatcagtagttctgccagggcaggacaagtcatgaaaacccacaacttcactgctgaaagggggtgattcgataatttgatggagcagaacatagaaaaaccccatgcccttaggtgtggtcaaaacagtgacaatctcaggggcaaacaagcagggagaataaacatcatatgtagcctgaagttacaattcagagtagaaaagaactggcagattggccagaaatttagcagggagaattggaaaaggatactatcatagtgaactttggtaagctaccacatattcctagaggtctgaaaggctgcacacatactctggggaagacctaaggctttggacacacagagagaagataagagagaacaaatggaaagtaaaaatcaaaaaaacacttgtaaactgcctgaactttgagtgcattctacaacccacacacacgtatatatcaattagaggcgttagcatagtggccctaggtgtttaagtacaacctgtgactgatcgttggctgaccactaaactgtgttaacacaggggaaagtcccagctcaaaaacgaaaatggaaattacacaaactgagcagaaacatcagcagcggcacagcatggggaagagaggctgcacagagttatgttaggcaagtcctaaataaacaaacacagcaataacagcaacaaccctcaacagggaaaagtcagaagccagagttgctgtaatatgctatataaaatgtcaattttcaagaaaaaaatgagacatgtaataaacaggagtgtgactcatacccaatttaagaagtggttaaaagaaagtgtctgaagaaaaaaaaagaaattatatttgggttgaagtggagatagcagatgttaaacttagcaaacaaagagttgaaagcactattataaatatgttcaaaataataggaaatcatgttaaataattaaagtattactataattaccctttaaatagagagtatcaatataaacataagtgttattttaaaaggaacaaaaattctggagttaaaaaatattataatggaaattaaaaaattgcaagagaatctcaacagaatatttaagatggcagaataaagacacaatgagattgaagatcaattaatagaaatggtctaatttgaagagaaaagaacaatgaaaaaatgagcagagcttcggagacctgtgagagaccatcaagcatactaacatatgtgtaatggtagagaagaggaggaaagaaagaaagggctcaaaaatatttgaagaaataatagccaaaaacttcccaaatgtgatgaataacattaatctacacatttgagaagcacaaaaactccatgttggataaacacaaaaaaaatctgtacatagacacattatagtcaaacttttgaatgaaaaagagaaaattttgacagtaacaagaaaaaaaagactgttacatacaggaaaacaacactacgattaacagcttacttctcattagaaacaaagccaggaggtagagggatgacgtattcagtgtgctgaaggaaaaaaagggaaaatgtcatttaggaattttatatttagcaaaattgttcttcaaaaataaatataaaataaagatatcccaaataaacaaagactgagacaatttgttgctagtagacctgccttaccagaaatactgaaggaaatcctttaagtggaaatgaaatgataaaaatgtatctaaaattcacctaaacaaaaggacctcatcacgtcattatttaggtaagtatagacatgatataaacataaaactaaattctgtttgaacagaaggaaggatataacaaagataagaacagaaatcaatgaaatagataatgaaaataatagagaaaattaatgaaaccaaaacttagttttttgaaaagatcaaccaaaacttagtttttcttttgctagactgatcaaggaaaaaggagagaagatgacagattaccaaaatgaggaatcagagagaaggtatcaccaccaaccccacagaaatgaaaaggattatgaggtatagttatagttaatactatattataaacaaatagtataacctcataatcattctcatttctatggggttggtggtgataccttctctctcattcctgatctcatactatactatgaacaaatattataacctcataatccttttcattgcttgatagttagaaatacaacctgtgactgatcattggttgacctcaattgtcattgcttaacaattagacaattgttagcaactggacaattgttagcaattagctggataaaatggactatcttagaaatgcgcaaattaccaaaactgactcaagaggaaatagaaaatatgaacagactcgtaataaaaagacatacaatttatacaatttatagttaggagaaaatcctagatgtagatgactccactggtgaattctatccaataccagtatttcacaaacttttctagaaatagagcaagaaaggtcatctttcaattatttgtacaatattacactgagagcaaagccagacaaagacatcacaatgaaagaaaactgcagaccagattccctcatgaatatagacaccaaaactcaacaaaatattcacaaaccaaatgtggcaaagtagaaaagcattatacagtgctgaccacagaggatttatcccaggaatgtgagtttcacttaacatccaataattaattaatgcaatatagcatattaatagaataaaagagaaaacacatgaccatttcaatagatgtacagaaacatttgagaaaatccagtatccatttgtgatataatctttcaacaaaaggaatagaagagaacttctgtaacctgacaaagggcatctatgaagaacttataatgtatgtaatgatgaaaacctgaccgatacactcctaggatcggaaaagaggcaaggttgtcagttcttatgtcttctgttcaacattgtacaggagattcaatccagtgcagaatgataaatacatgtaagaaagagagagagaagcaaattagaggaaaaaaaaaagaagcagcagcagctgcaggggagggggaggggaagggaaagagaagggttagacagaccagcagaaagaaacaatcagtggcatacagattggaaattaaaaagtaaaactatttatttgccggcaatataatcttgtacatagaaaattctaagcaatgtacatacacctcccccaccacacacacgaactaataaaggaattcaacaagttaactgaatataagaagagatattgtacagaaatcaattatatttctgtatactagcaacaaacaatgaaattaagaaaacagttcaattcacaatcctgtcaaaaagaataaaggcgtttttacagaaattgacaagctaatcctaaaatttacacgaatatgcaaaagatccaaaatagtgaaaatacttttgaaaaaggaaaacaaaattagataacgtacaatttctggttttaaaacttactttatagagtatgatattggcatacagatcaatggaatggaattgaaagttcagaaaattcatcatatttttgatcaattaaatttgacaaaggtgccaaggcaatttgtcatgggaagggatagtcttttcaataagcagtgctctgtaattgatgctaggattatatgcgatataaatgaatattcacgaacctaggactgtaaaaaacatattttagttcttatttcatatcctgcacaaaaatttaatcatgggcctaaatgtgagagctaaaattataaaatttctagaagaaaacaggagaaaatcttcatgactttgggttagaaaaagttcttagctatcacaccaaaagcttgattcaataaaatccttggtaattaggatgtcaacaaaatttaaaacttttgcacttcaaaagacccattaaagaaatgaaatgacaaaccaaagacaggcgaaaatatttgcaagattgcgatttgcaaatcataatctgataagaatttttacgcataatatataaagaattcttcaataataaaaagacaagcaacccagctaaaaactgggcaaaatatttgacaattcaccgaagttattcaccaaagaagatgaagtcatgcctaataagcacttgaaaacatggtcaacattattatttccagggaaaagtaaattaaaaccgtaaaagactacttcacacccgctagaatggctgtaataaagacagatagtaacaagtgttggaagataaagacaaattagaagcctcctatattaccaggggagatgtaagagtatagtcactttggaaagtggtttggaagtttcttaaaagttaaaataaacttacccttatgatccagcaataccactttgaggtatctaagaggaaaaaaaatatgtccacacagagacgtattttatgtgaatgttcatggcagcattattcgtaacagtaaaaaactggaaacaattcagatgtccattggctgatgcatggataaataaaatgtggtgttatatccatgcagtggaatagtattcatcagtaaaagggaatagactactgctacatgccacaacataaaagaatcttaaaaatgaattatgataagtgaaaaagctacatgaaagagatcacatattatttgattgcattaataaaaatatccaaaaagggcaaatttatagagagagaaaatatttgttgtctgggtctagggattgactccctaagggtatgaaggatctttgtagggtgacaaaaatattctaaaaatgaattgaggtgatggttatacaactctaaatttacttaatgtcattgagttatacacataacaagagtggattgtatgttatataagttatatctcaataaactgttatgtttattaaaactaagtatagagaaacctggcagacattctcctaagcaagcgaccaaggttaacataccccgagatatcatatacctttgatgttataagaagggcacatcacctcttttgtattcttctctaaaacctataatccgaatctagttacgggattggacaaatcaaagttgtaaaaggtttcacaaaatatctgaccactagtcttcacaattatcagtcatgaaaaacatggaatgaccaagaagttatcacagatcagaagagactgaggagacatggcaattaaaatgcagtatggtatcctggattggatttttggaacagaaaaaacatattaatggaaaaattggtgacatctgaataaagtctgtagtttagttaatagtattgtgtcaatattaatttcttaattttgtcaaatttaccatggttatgtaagatagtaacattaggaaaaactagtgaaggaaatatgggtactctctgtactatcattgcaacttttccataattctaaaattgttccaaaatacaaagttaaaattttaaaaagcaaatggagaatttatagattaaaggataattatcgtttgaatataatgtgtacatcttatttagatcctgattcaaactaaccagttataaaaagaaaagaccatttaaaagtcaatcatttaacatggacaggatatttaatgacattaaagaattactattatttttgatgtggaatgatattagttatgattgtcatctttcagtaacacatagtaaagtattcatgcataaaataataagctatctgggattgtctttcagatgctctggtggaagaaaaagtaggtgaaagtataattggaaaaacaattgactatgggtgatgggtactggagagttcatttttctgtattctgccctctctcatatatttgaaatattttataataaaaagtttttaaatagtggaaagaaaaaaatactaaaataaataattaaagtattataattagccttctatgctgaccacaaacagggctgtctcttaaaaatcaaatctgcacaatgtctgaataaataaattatagagagatgagtgaactctcaaaagcaatctgagcaagatacagtcagtactgaatagttggaagagcaataagagaagtgcctgaattaacatagacctcctaagctggaatgctttgttgttctttccttgaagttctgtgacctggtgatatctaaaactccttctgtgtgaggattttagaaagtagaatgtggtcagaagcagccctttgttcgtagtcaatggtaagatctgtagttctcaccccccttcaggttttgttttgttttgtttttttattgactagaggctttgtttgtggccttgtgacttacaagataggttactgcaatataatgcatttgctacttctctggaaagccattcagaatctttaaggagtgcagaatgtacaactcttttgctaaagggtctctgccagagaagcattcttccggattttgtatattgcattgattacggagctgttgctcagtgcatcattggatgttgactgtaatctataaagccttacatagttttcttccaattaaagaagtctgacactggtggtcaattttaataatgactgagattgatctatgtgacttaaaattttaacagattttggaacctgaaatgtgagaaacaagttttcttattgatgacacatactctgaaatctattttaaaggtgggttcagtgtacagtagtgaatttgaattaaaaaaaaaaaaaaaaacagaaagttgaaaatagacaaaagtgccaaaaataaggtatttgtcctgactttctgttccttcatctcacctgacattccctcagaatattttacatccttgatgaccagtcttttaagcaattctacctgataaccccactatatagtgacagagttactgatttgttccatgaggagataagaagaggagcactattcatatcaaagacaactggtcctacttccaggtccatctttgggccaagatatgtagtcgccaacagtgagttggcgactatattttttgagtcctggcgcaaagtaagatccatctgttttgcccagccgtttgcctgagtgccacaaaatggtcctgttattagtcttatttgtggtcctatttgaggttaggtataatgtaaataaatttcagttctcctcgtgatgagtagtacagcatgggaattaagagggctggtgttggtagttgtaagtgatgttgagtctctattttttcaattgctctgttttctttggattgggaaacagacatttaagaatgagtttgtcatctggaaggatagttgtgaccaagtttccctcaacaggatacaagatgttatttttgagcctcattaccctcaccaagagaaaaaaaaaaaagaaggaaaaaggaataagaaagaaagtgaaagtggagaagaaacaagcagaaatagaagaaaaagatcaaagaggagaaggagaaatggcatggggggggaatgaaaattggtacactgaccatctattcatataattgatttaattattttgagctgatagttcaattcattcaacatctggcaaattgaggagaaggaaacctgactgaatgaattgaattactagttgttagttatatgtttatatgtaaatattcagcctagtttctatcaccttttcacgtctaaactagagaatgaatttgtttcgctaaccatattttgttggtgagtagaacaatgccagttggtgaattagatttatccagaggtgggcagttttaaatttctgaatcatttttcagagattattgttattcaatatatttatattatatctcataatttctgagcacaagttatttttgtcagtttcttttatgaatattttgctgccttataaggaaataatgtgcactcccctcctctcattcagttgtccctggtgacgcctccataatttctgcctttacgctggttcatttttagcctaattcaggcatgtgagaggagggggaaaagtttagttagtcaatgtcagtgattttttttaaatctaatctcattcatgagtgaatttactgtgaacctgagcatgtttacgcttaaaatctatgtacatcaaatagaccaattacccaaaatattcctctatacatttcaagagaaaaagaaaacaggaatcccaagtaagaactacatatgctttctaataatagtacaatttaaggggtgatttgtgattatgctctcatatggggaaatattaaaatattaccttgcactaatgtgaaattggatgtaaacatatgacatttagtgttataaatatatagaaagtattctgccacgctgtaaagtgaatgaaagcgaattatattacctcattttatattttaaaaactaaatttttctaaatcccattgtatcagtttttcaaagctaaaagtaaggatgatttaattctagtgtgtgatgtgatttttttaatttaaaaaatactattatttatagatggtgttgtttgaagaaagaaatgattcaaaaaatagtataatattttaagcctaatatttattatatacttggagctcttaatgcctggactgttacttaatttggaattataagtacatatttaaaaaataagcaacatgcttacagttacttaaaccagggagtgttgttcagactctcttggtcttcctgtgctgcttcaaacagcagtggctgcatgtgacaagatgtacaatatgatgtgaaatggggcacgctaaacccataatacagtacatttcaatggccattttgtgttgttaaatatgtttatttagcccttcttcaccatctacctcaccagcaattcagtcactggaaagtaggagatctagcatttcttacaattccatttgaagtcataatttccctttaatatgtgtattcagacccatagattttcttctttattccctgaacttaatattttctgtaatctttaggctgtagaaattgtttaggagtttttttttaatcagaatatagctaaaattcagaaacattgagtttctagtcatatcattatgaagtccttaacatggaggcgtattttgtttttcagaattgctttttttctcctctttagatccttttcttttcattaaaaaactactctgggaagagggttttttcttttttttttttttccttaacagaaaaaaaaaaaaaaaagaaaaaaagaaaagccacgcttgactgataatgcattgctttggatggtgaaacattatgaaagtttaatttttaattaaatctgaaataccaattataactgaaagagattttaacctgtttcttttcagactgcctgaagttacatttagagactgaaatcactgcaccttaaaaacaaaagattgagctgcactgtattcctgtaagtcaaagctttctgtaccttcttctgtgtttctgtgaccaacccaaaaaaggacaaaaacattggtaacatagtaaccagacatgagtaaaaatttgaatgtccctgaagaaatatatgtttaaatgattttcttcttaaaaaaaaaaagttgttggtctcaatattcagtatgtcttttttatccaacctaaattgtgaatcctttcttttggctggtttgaatttcattagggagggtgtcacccactgtgcatgagcacagtgacacacaccctgtctggaaagattcttgcttttttattttattttattttattttattttattttattttattttatttttactagtctcactgaaggtaaaagatttcttttggaatcaaagtagatttcattttcctttgtgatgtcattagaaatttttagcctttgtgtcaatggaaatggagagaaagaaagttcatgatgacatcacaagattctgttgccttgaggactttgggcaaaactaagtaaaatgcataattcccttgtgtgcgtgtgttccccattctgctacgaagcagtcaaaatagcacatcttatgtcttcccgtgagctacaaggctgtctctcagagccccattgttccataaatgcatgtcagagtctaccacagtctggtctacccttatttagctgctgttttgtcaatgtacttggaagaacaattaacatttgggatttcaacgtctgaataacaggcagtgaatagaacccaagcatataaaagattcagacgcccagggtaagaaaacagaagcttatagttggtgaagaaaaaaaagaaaagcatttttaatgctgcactcaaaggttgtgaaatactacaaggaaagtcaatctgtttttatttttaattttagatcaaaatgtacattttggtaataaaatccagaagcttatgatgtcttcctcagttttacagtttaatgtattgcaagttctttcgctaagagtcttaaaacacttacccttctattgttggaatgccagatgtggagtctactgtatcgtggtttttagagtgtcacagcccccagtcaacagagtacactaaaggtgattcagacaattgcttccattttcactgtagttcattgcactctttattgactgtagttcttgtgtgttgacagtagacagttctggagttgcttatatgtctctgcctatggtctgaattcctgctaagttcatttttgttaagcgatgatgcacggacagagcaaggttaccttactgtgattgcatctggtgaaatgaaggagactttggcactttgtgtatgttgcccactgagcatggtgcctggctggtatgagtgaataaatgatagttattgttattgttgtcataactacaacagttcaaacccacagacagtaaggtctctaagagcaggggctctctctttcttactcatttttgtaatttctaacccttggcacaataataggtaatcatgaaatagctgctattagtttaatttcaaaactttttaaaagtcagaaatccagggttcattctgtcagagaatatttattgtaaacacaggttgaatacagtttttgacagtcaggaagaagatgataaaggaatttgccaaacacaacctttctgcttatcatatcatacgaggtatccatctcccagccccttacctcattgactttacacttctttttcctgaccaaagtgagaattgaccattcataccacatccttttcacctatgaaatggtcttcagcatttttccacttaagttgtgtgttttatatcccacacactagaatcaactccacaaataaatatgcccaattccagggtagatgatgctctgatacctcagttcgtcttgccatattatagattttgtttcagggaaatgggacaagtggtacaataagtattgggtcaagaggccagggatttgggaaggaaccattagcagaatgtacttttagtgcataaaaagctaggaccaacttttcaacactaatatgaccacaatattctttagaactcagaaccatttgacaccttctaagttgtttttttttcttttttacatacatttatctgcccctcttccccaccatcagtttttaaaatttatttccaaaagggattctttcatttttattaaatgagcttctggtgatgcaaattaaggctctcataaaacttgacctctgaggcaatattaaaatgatgaaatttaggcttagtgaattctactgttatcatgttcaataacatttaaggacataaaagaattttataaaaacattttatatattttaagattgaaaagtttaggcaaatgtaagggcagagcatcaccaaacattatagtgggaaaggatgtaagaaacaaagtctagtgacttcatttttaaataagcaaattgaggcacagggtagggcacaaaggttacacaaaccatattgaccaccatcgcagatcatccttagagacctagacgtgatagtctatctgaatttacaatctgaggcttcaatctttccactacaatcagggtctaagcaatgtttcctgaggagcaaattgccttgggctcattttttgagacttgttgaattgtagtccccttcatcagaatctcaaattcatatataaaggagtatcctgaaaacattggttgttatcaaaagaggtttttttgtgtgtttttttttgtttttttgttttttaattttgttcctagtatcatgcctttggttgagcaacgagtcctgtagaggcaaatttatttggttgacttaatattctttatgatgatttacaaagtggacataagaccattagaacttcagtagtttaattgggcttacagacatgatgaaaccagtaatctgaacagaaccatagtggtgtggaattcaaacttcccaagggtgtgtacgacgcatggtgtcagaatgtcactgttgccaggggtcatttccatcagagaaaagttttccagagtcagaaaaaaaaagaaataagctttaatattttaaaatgaattacttgctctggtcatttgtttcacattgctttcattggattctgtcatttaccaatccaaagaggctacggtaaaaacctgttattttacccaaagctaaattctggacattttctagtttcttcctttattttaacccatccaggtcttccctctctccaccatgtactgaaagttagtggccttaagtctttgtgcctcaaagacaaagagacaatagttctgccctttaaaaattccatggaagctttggcatatagagaaggaggaatcgagacatggtgataccagagcagggtcctagatgtagatgttcaacaaagttctctcttcaaacctcttctccctttcctttataataatgaattaatgttctgtgcctcctataacaaaatattttaccaagatacacagataaataacacatattttctgttattaaggaattcataatttatctgggaaaatcgcatctttcttatagacaaaacattatatggaatagcagaggaagtaaatggttatcatttttttctaggccatgaaggaataatgtgatactagcaagaagcctatgaagagggagtaataaatgaaagtcaggagaacattgatagtattggtgtgatttcaacatagaatgcttgttggggacagtgactagaggaggaattggatgagaaccataatgtatgggaggatcagttttccaaagtgtgggttgcaacgcattagtaggtcatgaaagtttaaaagatcacatatactagaatcacaggaaaataaatattttttaaagcacatcacatatttttaagatactagatggcaaaataagtgtatttcttatgagaattatgcaccaaaatataaaagcagcttaaacatgacagagcttttaaatatttaactcatgtaatcctaattaagggataaaattattttcttccttatatatgagaaaatggtggagttaagcaatttgccccaggatatacaacaggtaaatagtagacacaggatgtgatcacatctgtcatactccacattcatactcttctcatgacttgacacagcttctcagagttacatgacttcaattatttcactatggataactcagaaatttatatctccagtcctgatatgtcttcagaactttagtcctatatttccaacatccttatttaaatcttcaactagaaatcacactagtttctctgagtcagcatatcaaaacttaatttattcttctacttaaaaaccatcctgcttttgactatcctagcttctctaactccaattctctaggacatctttactcaaaatatatcattctttcctcctcttaatacatcctagatgtccagtaagtggccaagtctcatttattctctttctttgatacctgttccagtcaggattttatcttctcttgcttacaaaaatctcctaattgaaagagatggagcagggagatcagtttatcctaaacactgctgccccattaactttcctaatataggagtactaagattatgtcgcctttgttcagataaaactttcaataattctgtgtataacaatccctaatcaatatacatgacatcctaaaatctaactctgatcccatttcttagttaattgtcacctaccgggttgtatgtactataaactcaggccgagttctcttactcacctttattcatattgttccagcatctggaatgtccatcattcaattttttcatatgcaaatccaacccatcctaccaagttcatttccaatgttatgaatttcatgaatccttctttccttgacctggacagaaacaatccactctcccctaactatcaaatttacttaccacctgtagtgaccctgctgacaacttgattttggacttgtagcctccaaaactgtgagataataaatattgggtattatttataagccaacaagcttgtggtagcttgtcacaacagctctaagaaactaatgcaatactcatctacacttttattgagacaggaattactttctatattttatagcactttatgtgtatgccttattcctttactagaaaacaaaattttaagggaatagtccatatttaattaacatttcttagccctactgagtctaccacaatagaatcattgattcattattcaactatatttaatagtagaaatatagaaatgatcccttagaccttcatcatgaaattgatagtctcctaaggaaattagacatgtaataagtgcaaacataattacaacattacaagctgtggtccacataaagtgttatgtatgcaagacaacattgagtgggggaaatctcttatactgtcctttgggtgttcaggacagaattctcagagagagtgtcctttgatttgaacattgaaggacagaaaataatatcagccaggtgaagaatttggggtagagaacggagtatgggaggggagaaagctccagacagaaactgcatatacaaaatcctgtattcaaatgcaaagctttgaatcagactttctgtattcaaagaactaaaaggacttcagagtggccagagcaaagtgagcaaagcagaatggctggaggtgtggtcagagaaatgccagagtgaggaattttaattttattctgaatgcagtgggaaagcacatagtagatacacacaaaaataccaattgaaggatagctcaagaataggacaagatcaaaattaattcaaaggtaaataatatacacatgctaacaaaatccatacatttattttaaatccttcctgaaggtttacctctgagtttgaggagagcttggacttctgaaatagaggtcttataattcaaaacatatttctcacttgcataaacagagtagatctctgacaaccttctaagataaggtcaagttaattttattttctttctagttaataattattaaaattctgttgttggttaacggatttcttgtttttgtttatttttaagtggctgttgtgtaatgtagagatgcataccaaaaatgtgttttgttcctagaatgtattttttatctgttaaaccttaatctcatttttaattttggtgtattttatcatgtgcaatgaccgggcacctggaggcatagaaaaccttgaaaataaatcatcattattctcattattactacctacaacatgactggatttctggattgaagaacaatccaggctttttttaagtatgatgcattaataacatggtatgccactaagccagaatagagatattggtttgtttgcaaagtgatggaaattatccccttttgcaattaaagaagaaatagagtagagggaatgtggaaattaaaccatagagaagtagcttaagctctaaagatatgaggatttatctgctatagctcagtaaaaagaccctggaaccagaaaatgttatagcgacagggaatcttaggaattatttattctaacctcttcattttggagacgaacaaaattcaggcctagaattcctatccaagtcatagttaaatagtcaatggcaggggctggtactgtaatcccaatactcaggagctaaattaccacagccaaaccagctaatatgtgatcaaagcccctatcataaccctttcaaggtcttgtgtagaaaaagaaatattaagtgcaggagatgagtctatgtacaaaccttaattaataaaaaatctgaacaatatatattacaatccatttacctaatataccagatactgtataaagagttgtctgtaatccttgctaccacactcagcaactacccagcaaagtaggaaccattcccattttataatgaaaaaactgagccccagaacgattaagtagcatctaaaattgcaaagccagtaagtgaggtttgtattactattagacctcactgattcaaactctgtgctatctcctgcttggtgtttttaaatctgttgcatttagttatagcctaagctagtgtggtcacagaggtcattagttctctaatagcccaaatgtctaaaagactgaaaaaatttaggagggtaagaaaaatagttacatttagcagatgccctctccataaaactcttcacatttaattctcacagcattgactgtagattgatgtcataatctttagttcacagtatcagaaactgaggctcagtgagattacattgctgtatacattttagtggaaaaaagcttgagcctgcattcatactctgatatatctgactgtaagtgttcttcctattattctacccacatccaagtctgttcttctcttggatgctagttagttttctatggtttacgcacctcatctggcaaagtagaattgtaatacctgctgtcatagacttcccaaaaagagagagtgcgttgagaggttggctttataattatatcataatggctggaaataaatgtaatgtcctctatacatttcctcctttgaaaaatggggatctgggaagattggtaagatctttagcattagactttcatttctgcatcatcttgatttactgtgtctgtgcccaataccccatcatatcacatataatcgttccaataacctagatctactgaaaaaaacctttgaaaaatgaatgagaagtaaaaaattgtaattattagaccaataagaaggaataattccaatgtttaataattggggtttggtgtacatttttcttcttaagactaacttaattaaagccttatagtgtgatcagaggtaaaggcctatgaaggtactcagccttattgctgctatcaaaatgcaaaactttggggccaggcacggtggctcatgcctgtaatcccgtcactttgggaggctgaggcgtatggatcacttgaagttaggaattcgagaccagcctgaccaacatggtgaaactctgtctctactaaaaaatataaaaaaaattagctggggatggtggcaggttcctgaaatcccagctacttgggaggctgaggcaggagaatcacttaaacccaggaggcggaggttgcagtgagctgagatcgcaccattgcactccagcctgggcaacaaagcaagactccatctcaaaaaaaaaaaaaaaaagaaaaagaaaaagaaaaactttgaaaattcaaacatacttatgaattgctagcactgttttctaaagaccagtgaggaatacatttgaagtgaatcccttggtaaaaccaggacagagagatggacgggggttgaaacattgctgatgatgggtgccactgcaaacataaccctgaattaccttccatgtgtgccaactttaggagcactgcatgtaaacacccccatttctgaagaggtcattttctattactgacacacttgaacaagtattctaaagccaactcttactgtagaataattatctgagtctgggaatgggatgtggggcatcagtatacataacaattttacggtaattagaagcaatgctacctgttagggtcctccagtagttgtttcttccccctacttcttgagctttgacttctgagattatctgtgtgaaagcccttagcagtccattgaaatcttctaaagtaaggcagttaaaaaatatctttcctgcttagcagaagggactttgttctttggcaccaccttactctttgcaatatgttgctagtagccctaaatcagaatgtgcattaatatatcttttgaattgtttggtctcctcaggagaaaaaaaaatgttttcaacaatcttataatattttgttaaaaatccaattctggttcaatgttttgttctcaaaggaattttgaatgaagaaaaagcttttgtaagagggaggaagcttatctaatctcttcaagactgatgagaagcaatcaggagcttgtgactctttgaaacagtaaatttctagggaattgggcacacgtttctcaggaacaataaagagtgttacacttcaggttggctctaaatgcaccccttcatgtatcccaaaaggcaatttgaaagcaccgttctctgagtcaactggaaaagggaggaagccatgctgagctgagattctttcagggggtcaagagacactgaatacagaatgaagatcactcttctgattactgtcgaattctcagttataaccttttttaataaaatgtcttcaaagatgtaggaaaataaattggctcagacaagagagttactggatattagaagatttagatttttgacaaggtcttctacttgtttgcaaatgtactatcttgaccatataaaatttgcctaacctttgctaaaatttcactgaattgttctttgcttacattacttgatattttaagactttgttagataatcaataagtgatagatgtgtagcattgttactgttgccatggttaccatcagtgttctcttcccttctctaggttagggttggcaggtacagctatgaacctgggttccacatctaaccccacatctgctcatcttcttgtagcactggaaagtgtgaggggcctgactagactctggctgctcagtagttaacctacactcatctcacctgaaaaacttgtcagtgaagttttagtcacaagccttttagaagatagaaaaacagtttgcatggaaagctctcatttttaaataaaaactgattatatcaagctaagtgagactctctaattgatgacataatactgtctacgttatcattgcttaccactagcaaggcagcaagtataattggaaggaaagagtatggggctatctggagacttgattcaggtgttgtcagttttgtcttaacatcattttccttatctgtaggggacactttctcctatcttaatgacacatgcagaaaagtcaaatgatatatgtgaagcattaaatatttagagttccatggaataaggctagtttataaatatcatatattacaatagaagtactagtggaaatgtaaatcactttgaggtctcaagagtaaggtcctttatctgagttcttagtggttggaaatttgtttttgagtcatcatatagggaagtcttctgttgctactaaatactgatcatgcattggaaacaatgaagaatgaattgctagtgatatattacttcttttaaatagttgctttaaaagcatttgttactataaattctctgagaagtttctctcaaattaaaaaaaaaaaaaacttactgttatgtctcccctatgatagtcagtgactttctggagggcaaaaaaccaggagtacctcactgattttctttcttggtcaccaaagctggtaccagataggtcttcagtgtttgttgagcatcctgtgtaaaaatttagtaatacttttagtaaaatttgtaaaaaaaaaaaaaaaaagtatactgatttcttgaattggactacatgcatatcatatgatatggacagatgattcatccatgttattgaagataatgcagccattaggaaaagaatgaattatatctatagctgttaacctggaagaatgaccataattttcagggtaatgagtatttatgaataaatatgttgcgtatgtttatatgaacatgaagaaagctatagaaaataattcataccatattcttcacattggttatttcacagagttgggaacaaaaaaaggaatcaggaaagattattaattttttctttaaatagcttttattgtttcaccagttacaatgaacatctattattaaagaagtttgcaaattaatacataaaattgttttaaaaattctttaattctcagataagcagactgagaaaagtaatcagcacacagaagttttagtttcatttgtattgcaacttctgcagcacaaaagaaaatgcatactgtaagcagactgattcatttaatcaacaaatatttcctgagctgtagttggtactagttcttgttaatgaaaatgtctgtgtgtatgagtgtgtgtgtgtttgtgtgtgtgtattcaccgtgctttggtgtataagataaatgtttacttagatgataaattacatcatgtttcacttataaacctcaggacaagtgtttaaatggaacaaaaatatacacaatcaagagacttgatgacatttccagaactctataatctgcttaaatatttacctgtttatcttcttctcacctcatgacttccgcagaccattttcatgacttttgttctagtataagttttataatagcagatccttataatctagatattaattatccttgtaactgatgcctcttctactcttaactctaaaaggatacttaatcttttctagcttgagtggatcttttgctatttataattctaaatttctcttcccttcatctcagtatgctccaggccctaaccggcttttaaaattaccttcacttgtttactcttagctcccccaactcaggatcattttgtctcagaggttcctaattctagctgcatattaaaacctataaagtttttttaaaatgttaatgcattggacccacccagatgttctgctttggttgttaaaagatggagtctagttgcacgctaaccgcttataggaacccaactcctgtttcatcttaaaattttcaattcagtgaagtcaaatttaacatgcttcttcacattggaaaccatttttctggatagtgactgcttctctaaccagacaataataaagctttaacattatgcataatacagctctatgtatcatcacacagatatgcatgtgacatgcatacaaacacatatgttaagctaatgaccaaatttgaacacataagttgataaatatacaattgctctttagatcctatgcatgaaaataattaattagaccttgtgaccaaacttgaaaggtcccctgatatggtttggctctgtccctacccaaatctcatcttgaagtgtagctcccataatcttcgtgtgttgtgtgaggcacccagtgggaggtacttgaatcacaggggcggtttttcctgtgctgttctcatgatagtgaataagtctcatgagatctgatggttttataaagagtagttcccctacacacacactctctcgcctgcctccatataagacatgtctttgctcctccttcactttctgccatgattgtgaggcctcaccagccatgtggaactgtgagtccattaaacctcttttttaaataattacccagtcttgggtacatctttattagtagtgtgagagcaaatgaatacatcctgtttaaacctaactattgtaaatgaaatgtcctatattcctaaagagtgtcagaatatgacttgagtctgactagtgaggaaaaaactggtggctgacaataatgtcaaaaggaatgcacagttgatagccaaaaggtgaaaacaatccaaatgtccatgaatggacaaatggattaacaaaatgtggtccatacatagaatggaatattattcctccttaaaaagaaataaaattctgacatatgctatagcatggataaaactttaatgcattgtgccgagtaagtacctagtatagtcaaattcctagagacagaaagtagaatagaggttaccaggggctaggaggaaggggaaatgggattattatgtaatggttacacagtttgaatatggaaaagttaaaatgttctagagatggaggtggttttgatacttgcataacagtgtgagtatacataatgccactgaactgtacacttaaaaatggttaaaatggtcaatttttaatatatattttaccacaataaaaaaatgtacctttgaaaactctttaaaaatatcagtgaaaatacattgcagttacagggtttagaagaaaaattgaactacatagtctgttcacagaatcattagatttttatgaaatatggtaatttattggcttaagtaacagtctttaccttgctgtcatacttacaaaattcaaatactagtgttatccttgattaacaggcagtaatgactgtaatgaactattagagactatgttttaaacaagcagagaattatttaaatttgtagctatgttagacattctcattttggtcaactaatggcagggaggtagaactgcaggtttctttttcatcaacagtgttatctcttaccaaattatcttattagtaggagaaaccatggctttatttgagcctgtattttccaataattcaatatgtaatcagttactcccttttttcctctgaaaatgttgaatatttttactgacattaataaacttcttggtatacagttctatgaattttaacatatatatagatttatgtaacaagcaccaccaccactatcagaatatgaaagagttccatcacactgaagaacttcttcctttatccatcctctcaccactaactcatggcaaccacagatctttttatcattatagttttgtctttccaagagttgtcatataaatggatatatatgtatacgtgtcatataaatggatatatatgtatatatgtgtatatatatgtgtatatacgtgtatatatgtgtacacacgtatatatatgtatatatatgtgtgtgtgtgtgtgtgtgtgtgtatatatatatatatatatatatatatatatatatataaccttttaagactggcttctttcactcagcttgatgcattaagactcattcatggctgggtatggttagctcatgcctggagttccagcagtttgggaggccaagggaggaggaatgcttgagcccaggaattcgaaaccagcctggacaacacagggagaccctgtctctaaggaaaaaaaatttttaattgactaggcatggtgatgtgcacctgtggttccagctacttgggaggctgaggcaggaggatcacttcagccagggaggttgagactgcagtgaaccatgatcatgcactttagtctgggcaatagagtgagaccctgtctttaaaaaaataaaataaaatattctttcatatcattgcatgtttcacgatttgtttcttttttattgctaagtagtgttcctttgtatggatatacagaagatcatttaccattaattcactgaaagacatttgggtaatttccagttttgcattcccactggcaatgtataagagtttcagtagctccatatccttgtcaatatccttgtcaatacttgatattagtatttttttattctagtcattataaaaggtgtgtaatggaaatactttttttcttttagccacatttttttttcttcaaactgtagaagataatgtgattctggagccataatcttttctgattctccttttcagtactttctatttctatgtactattttccacaggaaaaagatctattattattatatttctgatactattattttcccccactcctcttggaaattctgttttttcctatgacagtatattaattcaattttttagtttttctgaaattcctttttttgtgtgatttcacttttatgtggaatctttttaaaaagaagctgaaaaccatcattctcagcaaactaacacaagaacagaagaccaaacaccgcatgttctcactcataagtggaagctgaacaatgagaacacatggacacaggaaggggaacatcacacactggggcctgttggggagtgggggtctggggaagggatagcattaggagaaatacctgatgtagatgacaggttgatgggtgcagcaaaccaccatggcacgtgtatacctatgtaacaaacctgaaagttctgcacatgtatcccagaacttaaagtataataataattaaaaaagaaaaaaaaagaaatggtgtttctcactactatggcttgtgatgtattgaaaacatggctgttcactaccatggcacacgtttgcctatgtaacaaacctgcacgtcctgtacatgtatcccagaacttaaaattaaattaagaaaaaaaaagtagatttcaaaagtgtaaagaataaaatggtgattgccaggagctggggacagggatatcaggagaagttcgtcaaagggtacacactttcaattataagatgaataacttatggtgatcaaatatacagcatagtgactatagttaataatactgacttgcatccattaaatttacgcagagagtaagatctgaagtattctcagcacacacacatactcacacacatgcacaatggtaactatatgaggtgatggatatgttaataatcttgaccgtggtaatgtgtatttgataaccatcacattgtacatattaaatgtgtaaaattattgtcagttttacctcaataaaaccaggaaaaaatactgaaaactactccaaaacacaaagtaaaatataataataataaataacaatcaattccaccacttaaaaaataaattttaactggaagtgaaaaaacttccctctgtccctaaaatcttcttctgtcaccccctaagataaccactgataacattcaacacctgatgtgctaatctgaaataattttatttcagctaccgtgttcttaatataatttgtctccacattagacgtacaaagagaatataatttaatagtttgaagattatcctttcctgttgtattatgtgtttttcatctaactggctgagatacagcaagttttctctccaattatataattacctaaatagcatgacatctctgattttgcctcttgacccacaaagcctaaaatatttaagattttatcctttttggaaaaggtttgtcaactcctatttcagctgaaggatctaaagcccagaaaagttagatgatgttcccaaggtattggttagatccattttgtgtgtgtgtgtcttttggggtcagactattctgatattgtatggattctggagtatgtctggtttgaatcctacatccacccgttactaccctggtgatctagagcaaatgacttccctttgcctcagtttccttgtttataatatagtattgttgttagcattaaatgagataatatatgtgaaataattacagtgtgctttgcacatggttagtactccagttaactgttagctattgttataattagtgtcaatgtgttgaattcataggctatcctaaagagaagggataaatgttcacatctgatccagtctcattttcttaaaatagcagcgatgttatatcatctgtaatctgaggaaaaactggcatttattcacattcttatttttgtagtatggtttattcatccttcttttcaataactttacaagttaatagaaattatgaacttctaaaatacatgcataatttataatattgattaacttaaacacagagcactcaaatgataaccacatagcacaccttccctgagtccagcagatgatagtgaaaactctttgttctctcatgctgtgtatcttgaggacattttcactatatttaagactacttgaactgattacaattcttttatgattgggcagtggatcagtggctgggtttttaaaaatcatatttaattgtattttgtgcaatggtgaagtgttatatttctgttcactcttttctgttattcacacaaaacattacttgcccagtttattgtttctgttcatctactgcttagactacaaagccatgatgttgagctagatgaaatccagttagataaatgcagtatatattggatcagttagtattttactctgttagtcctcttgcctgtggcaactctagttaactatagaaagaaaaaaaaagttctattcctccaaaagaattaaaatgaaggaggacagcatattttctgctttaaaaaatctagaattgtggtttctaaagaaaacccactgtgtacttgataatttctaaagaaaaatttgttatggactataggttataccttgcatttaagaaccacaacgaaaagaccaactttaacttctcctcattaaaatgataagaattggtattgcctataattgtttccactgtgactcctatgtggtttttgttcaatatactagtccaaacaagattttactcttctcagccctgtagatctaatctcacaaaactaagcatatttttttcagtttcatacatcatcaccatcatcttcctgaggatgtatttttttttttttttttgaggcagagtcttgctccgtcaccaggctggagtgcagtggcgcgatctcagctcactgcaacctctgcttcccagattcaagcaattcttctgcctcagcctcctgagtagctgggattacaggcacgtgtcaccagcccagctaatttttctatttttagtagatacggggtttcaccatgttggtcaagctggtctcgatctcgtgacctcgtgatccacccgcctcagcctcccaaagtgctgggattacaggcatgagccaccgtgcctggccaaaagatgtatcttaacagaagagaaacactggagtaggaaaaatgctgccatgtttagtcttaaggaatttaagaaaataaattgatttgtgcttcatgaatccataattaaataggtagttcaagaggcaagattttgaatagcaaacagtataagtaagacccagatgtggcagtctactctgtaggtaaacaagaccaaatcagaagaaattcaaggtcaataaaaaccaccagcactttatccaaatatagttctgccatatttatgtaatgagtttaagtataaattgcttataattacatatttccataacatgtagtactttacctaacataatatgtattgcattataattattaatttaattgtctgaacctacttcttatgcagagactttattctgtcttgaccaccgtggtttccaatgtactcagcacagttcggaatttgatattcagtagattatcacattaggttgaaagagtgaatggatgaatgaatattcatgaataaatgaattttttaaaggacattattattattttatttactggactgattgccatacagggatatatgcatcaaataatagccaatttttcaagtatattgggaattaggaatacctttgatgtttatgtcacctattcacaggactttcaacttatctctgcatatcagccagtttctacattaaggatataagctctattttcacagatttagatttagtatttgcatcaagatcctgctcaaatattaccttctctactaaaattaccttaattccaccatctataattaattgcttattctctcatctcccacaacacattatctaggactctatttattgaatttattttcaggctttttccatggtttattaggcagattatatttgcacccaacattaacattgcacttagttactcaaatattcatgcatttttaaaaaagaaagttattatggttaaggggaaaaaaaacttacacatgtataaacttcaaaaatatttcatgctcacttagagcatttatccccagcacagagatcagagatccattgtcagtaccataatagctagctacttctacttcaacacgcccctccattggatagaacctgtgagtcttagctctcgctttaaaatcaatagcctcccccattgtagtaactgttattaattaactaagtcattcaatccagaaatatgccactgagcaactactgagcaaaagtgaatgggacagtttttgtcttcaagtagaagaccatataataacaaaaaaaagtatatgtaaacaaatcattacaaagcagcaggttaaaggctttgagacatgtataagatactgtgggagcatataggtggagcatttgcttgctgaagagccagcacctccactttcctcagtgagtgctttcatgttctccatatcagaagatgtatgcatcctgctaagcctcttctgctcccccattttctcctttgccttgtgtattagtctgttctcacaataaagacatgcaagactgggtaatttataaagaaaaaaaggtttaatggactcacagtttcacgtggctgggtagacctcacaatcatggcggaaggtgaaagtcacatcttacatggcagcagggaagagagaaggaaagagccaagcgaaaggggaaaccccttataaaatcaccagatctcatgagacttattcactaccacgagaacagtatgggggaaaccgcccccatgattcagttatctcccactgggttcctcccacaatatgtgggaattatgggagctacaattcaagatgagatctggatggggacacagctaaatcatgtcatcttgtgagagtcacttctcagttactttaagccacaaatgggtgtagcattttagattactccccttaaaaggatgagaatatctgtctcaaacatgtctaaagaaaccacactaaggcttttcctcatactatttcattaatcctactgaaataaaatattggtatgaattaagttaggcagccatttgaaagacaaaatgccttaacaagtcccattaatgagaaacaccttatctcccccctgcaaaatgtttaacaggcttgtacatattagaagtaacagctaacatttattaattactatgtgccagtccctgttctaaaagatttatatgtaaatttatggcattccatcctcacaacaactcttgtaaatagtcactgttgttatcctaattttactggtgaggaaactgaggcacagagagaaaaaatttgcccaaggtcaaggatggggcaaaatcaaaattcagtcccagggagtctgattccacagcctacattaaaaaaattagtttttaacttttgtgaatacatattaggtatatatatttattccttagtatcaagtcttcaaattaaaatttgcctttatatgactcttaaaaatgtttgttttttctttatagaataatatttattttaagatagagttttacaatggttgttatgtttccttcaacttgcatattctggggaagtgagaggtaatatacagtgtaaatgaatgaacagttagcatgttggtaatacagaatatgtttgcttatttatggtaagtcatatgattccctagaggtaaacctgtctaaattgtttacgtgtttataatctaagtgattattttaaaaatggatactacgggccaggcgtggtggctcacgcttgtaatcccagcactttgggaggccaaggtgggctgatcatgagatcaagagatcgagaccatcctggccaacatggtgaaaccccatctatactaaaaatacaaaaattagctgggcatggtggtgcatgtctgttgttccagctactcaggaggctgaggcaggagaatcgcttgaacccgggaggtggaggttgcagtgagccgagatcgcaccactgcactccagcctggcaacagaacgagactccgtctcaaaaaaaagaaaagagaaggatgttaccaactttgtactatttaagctagtctctagcaatgacatggatatatattagagaatgcatctctgcttagtgctctgcaccaatgaaaaagcctttctgtttttcctcactcttcacttccaactttctactattaattctttttctccttttctcttcatataacaaccatttttgtcttaatgaaaaacttaaagtaggctttattaaaacactcacatattgtttcttcatctgtaaaatgaaggattggattacatgatcttaaaagtccctatgggaagactccatgatctacatgtttgatggagataccattttattaagaaaaaaattatgcaataatctattaccaagacacatatcatgacaatcattgatacagaacatttttattcaggatttaaagtctggttttattcaggatttaaagtctggttttattcattacagatttttaaaaattcactaaactacttcaaagaaaaaaataacttcataatttttgtgtatgtaatttgcctgtgtagaggggaattgtataaatctacccactttgaagacctaagtgtgtaatcaaggggtgtttattggaaaatttatattaagtaactgataacctgggattttgattaatttgtgtcttagaaacattatgactaagaaactagagacaagtccttgttcatttgtaagattcctaagtgtatctcatatctttccaaatgttcttgactcttgattttaaagtcccatttatctcaaccatttctccatcacagcaaactttatcatactaaaggcatcctcttatatttgttatagcacagtacagattattagctttcaggatcataatctgtgctaaaagggttaaggtagttttgtagtaggatttttaaaaattattttatattttatctctatagcactcaataatttatcacaaaggttacaaacccaaatgaaccaatctgcactgatcctggccacccattcttcggtgccgtgagttctatgtcaactagttactacttaacttcttaccaggggtgatagaactaagagaagatagtaacaggaaaagaatgttctcaaccctctaggaactcagaaataggtgagatagtgataaatgggaatgttaacaattgcctattgggttgttggaagggttcataaacaaataaagagtacctgtaattatatggcactatgaaaatctgcatagtttttttatagaaaggatatgcatcctgtccttctaaagataagttaggtgtacatagtgttaaagcaaatagaacaaggagacaaggagagtatgaagttggaattcatatcgactgctcagcaccccagatagtggaactcagtggcctctgaagtcctgagatttgaactgccttgagtccccctggtattattaggaaattgaaaagacaacacattgagattcccatttttcatgtttattgaaatgaaggtgtatagggataactattagaatttctttagcctcctggtactttgaatgacttatgttatctttcttttggtacagtagttatgttaatcatcagttactttttttaattttatttaaaaatagactgttcttcttgttttgaaaactactgccaaatgaatactctgtgttaatatgaaagtagcaaaaaataaatgactctgtccatcttttacatgttctgtcattggactattttctccaaaagaaggattctatctctagtagcttttcaaaggtactagagaacgcagccagcatttctacttgattttctcagttcttctcatttgctgattgatctagaatctctttaagctttccataatcttatttctttatctgtatctgtagtctacatctattagcttcatggtgattacgaagattaatggtttggttgttgaaaagccatatagctaagaagaatcatagagttcaggtgtatttttagttctttattaataatgctgctaccaagtgtttttaacgatgaactagagaaagggataaactgggtggtttggtcacaataattttgctattggacttttccaattttaagttattgggttttttgttgttgttgctgttttgttttgagatggagttttgctcttgttgccgaggctggagtgcaacggtgtgatcttttttttttgaatgtgtattattattattattattattattattattattattaacatactttaagttttagggtacatgtgcacaacgtgcaggtttgttacatatgtacacatgtgccatgttggtgtgctgcacccattaactcgtcatttagcattaggtatatctcctaatgctatccctcccccttccccccaccccacaacagtccccagtgtgtgatgttccccttcctgtgtccatgtgttctcattgttcaattcccacctatgagtgagaacatgcagtgtttggttttttgtctttgcgatagtttgctgagaatgatggtttccagcttcatccatgtccctacaaaggacatgaactcatcattttttatggctgcatagtattccatggtgtatatgtgccacattttcttaatccaatctatcattgttggacgtttgggttggttccaagtctttgctattgtgaatagtgccgcaataaacatacatgtgcatgtgtctttatagcagcatgatttataatcctttgggtatatacccagtaatgggatggttgagtcaaatggtatttctagttctagacccctgcggaatcgccacaccgacttccacaatggttgaactagtttacagtcccaccaacagtgtaaaagtgttcctatttatccacatcctctccagcatctgttgtttcctgactttttaatgatcgccattctaactggtgtgagatggtatctcactgtggttttgatttgcatttctctgatggcccatgatgatgagcattttttcatgtgttttttggctgcatgcaatggtgtgatcttggctcactgcaacctctgcctcttgggttcaagagattctcctgcctcagcctcccgagtagctgggattacaggcatgcaccaccatgcccggctaattttgtatttttagtagagacagcatttctccatgttagtcaggctggtcttgaagtcctgacctccctcggcctcccaaagtgctgggattacaggtgtgagccaccatgcccagccaagttattgttttaatatatctatttaagaattcttgggtttaggttccatattatctttgggttaaaccttaaaaatagatttttctttgaatagctaaaggaaagttacctcaagtgcagatagaggatctttatttttataatacagtatatatgtgccaaatatagtttatatttgccaaatcaaatgtcactaaagttaatgatactgataattgatttagggggaaaatggctggtaatacattatgtgtgtaagcattaacttaaatggaaaatactatagatttgtcctacttcataaaaaatgcaaaccagcattagaaaattagaacatttacattcataatctgtttaatcttctgttgaatgcccttgtgcactctctttgccctgttttagttccctacttgctgtagattataagtgcccttaatatctccagtatctccacagagaattttgtcttcaagccttggcatcctgttttccactgtgccttcaacctgagacttcagtgatttcacaaatgctctgaacaatggagttttgaaatggttaccatttgtattagtttcctgtggctgctataacaaactaccacaagcctggtgacttaaaccatcagaaatctattctctcacagttctggaagccaaaagtccaaaatcggtatcattgggcgagaagcaagatgtcagcagggctgcattccttctggatgctctaggggagaatccttttctttgccttcctcagcttctgctgaccactaccgttttttggcttgtggccacatcactgcaatctcagcttctctggtcacattaagttggcctcttctgtccatgtggaatcttcctgttacaaggatacatagaattgtagttagggcccatctagataatccaggataagctccatatgtcaaaattcttaatttaattatacctgcaaagtcttttttttttttcatttaaattaatattcagactccaagagttagaacgtggacacattttgagatgtcattattcagcccaccacaccatgtttacctttgtacctgctctgcattcttcccttgttctcccttctcctttccgctagcactgtcagccaggccaagaaaaaacaagagttgtccaaaggcttaactttcctgtccgcactttgtatgttagtaaaaaaaaaaaaaaaaagaaaaaaaattggaggagtaacaacatggcagatccaggcatcaagattttacagggttgaagaaaactaggtccatgatcaatggtctgcagatttgtagattttacataatttctttggcctggttcacataatttccatcctaatcctaaagacactgtacctgaacagacccagttctgcctttcctcagtgttaaccttcctccatcattgtgcctaaggcaagaagaatccaacagctcaatcaaatgtcaactccctgtcacactccattcaggaaaactgtaccatagcagtgggtcttgagtattcttatgctacataatgaagagggacattgcagaaaggtggctgtcgggaaaacatctggaagaaataaatttcctaggatcaaagggctccgtgtgcagcccagagggtcctcagggtgctcctcagagcaaacaaacagttttcttgatgagtcactgcaatttttttttttttttgccaaaagcccacatgtattgcaagatctcaaggaaaagaggtggagtaaggagaaagaaaaaaaaaattaaataaggcaacagaagtcatttttaagaattttaaccacatgaataaaagaaatatcaacatgattacaatcttttaatatatccaccatcctcaacattctgtcatgtatattgccccagagtaaagttaagtataagataaaatatgtttaaaaacacaaaaaacaagtggggcaaaggaaggatcttggggaagagtacaacactctgatacaacatattttttttgttctaacatatgaaaattggcataggatggtgaagcccaggactgtgtcccgaagcctagccagtggcattttactgaggaaaaaaaaaaagttacttatgaatcagtacagccatgctttgttctgcatgagtgttttaatagagcgagtgtaatataaggatcaggtgggctcgtgggaatggaacaaaaggttttgtaaaattaaagcaaaataattatagctctaggtgcaaagcaagcatactccagcagttgatagcaaggacctgctcagaatagagaaggaagggagcatgctggaagttttttcttttcttttctttttttttattcactaacaaaggcttttaataggtaacagttgtaaagcatctttgagagtaattaatgcacccacacaaaaatttattaaaatgaaaatttaaggaattgtctaaaatgaattaattaacaaaaaaagaacatcatgcctttcttattttttaaagaaggagagaaggttaagcaaagcagatttttgtgagattgtatttttaaatgttcctggtttatttagtatctgaatagcccttaaaaagagagttggcgagatttgttatccaccccctttagaaatattaaatggggacagacataaaatggggattaatttgctataaatgagcctcaaagccccttgaaattatggtatctccttacaaaatgactgaagtttttaataagtttacagggacctctaggaagcagaatgtggtattcaaaagaaaggaatgtgtgtacattttctcacgtggccatttctatcctgcattgcccttacccaggtcattggagctatccttccatgtgtggcctccatggaagacaaaagggaagattcaaagtgtggtattagtaatttttagctcagtatattttctatctcaacagaaaaataaaattaacttcatttatcctgtttctataagaattttaaatcattatattggtttgttccccttattttctttcatattatttcatactgtgatataattataaagtagaatatgtgcagcgtgctgagaatttaccttttactgtgaaaattatttctagtcgattgcaaaagtatttgttttcagcatgttgttggtagttatacctcaaaaagttttaggttctgaagttgagtaaattttcaaaggttaacttttctaaatcttcaatgccgaaaatcattggaaataactgcctttcttccaatattcctttgttcagttaagaccagaagctagctgtgtaaaaaatatgagtaagaaagaaaattcattttggaagataaattttaaaaactagctttggtgatgacatataaaaataaataatcatagtttttgaagataatttcctttaaaggtatgattataagacaacttgtatagtaggcaaaacataccccagtaggcatgtgatctgtgaattttgggtacatttgcctggactttctttctctttttttcattgtttcttaaatgttcattatcttcatgcctttataaactttcaagctcttttcagatttttcctgttgaagagagtggatttagttggtttgagtaatgttgcactgttagtatagtattcttgcctgtgaggaagagcacatttgtgaagttccttggtgaggacaatttgcacttgagtagatatacactccctgtgttctttttcctttagtctcgaggtattttactttctctgaggatatgactaaaagaaggaatatcggggaaaatgtatttatagtgttaagaactttcttttttcatagtagtggttcctgtcccaattctttactctatgattttaaactaatgtgtctgttggcctttggactgggatagtatgttggataatatatttgttttctgttgctgttgtaccaaccacaaacttagcagcttatgacaatacaaatttattatttgacagttctgcagatcagaagtttagattggctctaccagtttctctgctgtaggctttacaaggccaaaatcaaggtgtcggctggattcttaactggaggaaactctgaaaaaaaatccactttcatgcttattcagttcctcatggttgtgggactaagatctccatttccttgctatcagctgggaaccatctttagatccttgcatgtgtgctgtccctatatgtcagagccagcagcagcaccttgaatcattattacacttgacatctttcaaatttccccttctaccacacctcttttccaaattccagccaaaaaagttctctgcttttaagatgattagactgggccagcttggataatctaggatactctccctgttttagtgttaacaaccttcattacatttacagagtcgctttttcatgtaacataacattttgccatgtaccacaggttctgggctttaggcagtgggcattttggggtgcaattattttgcctcccacagatgaattctaaaagaatgagtcacctacctccatcatacatttctagagtactctgagtattctagtgcttttgatctagaagtagaagattcagtatgaattctcaccttctaaatgctattagtagatttttttaatatatatgttatgaaacttggtaaagagtatttattttctgtttgataaacagaataactaggggcgagggaaaaccaagttgaccattagggcttgaggtagaccagaaattttttggtttatggcagtggttttatttatcctaatccttttaatcactacaaagcatactagaaccatagagagagcccagctgggaaaaggaagtaagcccagatcaagtgaatcagaaatgagattactaatttattttttattttattttatttttttgagacggagtctcactctgttacccaggctggggtgcagtggcctaatctcggctcactgcacctccatctcccaggttcaagcgattctcctgcctcagcctcccaggtagctgggactacaggtgtgtgccaccatgcccggttacttttttgtatttttagtagagacggggtttcaccatgttggccaggctggtcacgaactcctgacctcaggcaatctgcctgcctcagcctccgaaagtggggattactaaaattttaatacaggtgattcacatggaaggctgagataaatgcaggaaacagaaaaatctcaagtctttcactggtatctaagagagtgtgacctattgagagcaggatgcaagacattattaggttggtcagatagatggcaacatttcaattcataggttggtaatatgggctaaggatgcaatagttaggaatccaagttaaataaagacttcagtttaagctgaaaatgaagaggaaagttctaacactttctaacaccagaaatacatctttagataaggtcaaaggaagggccaaaaggtcaaaaggaaacgtggacaaagaggggataaggaagaggaactggaggtaaatttcatccacactttggaattctgttcaaggttggctctggtatttgggatggaagggttgctttgaatattaagagagaaatatagtacaggtaaatccactagattataatttctattatatcatttccttaaggaagaaatgagctcacccctgcaatctgccatcttgtgtattttcatattagactatatatttcagagataaaaacaggaagtaaaatttttaagtaagaaggataatttcccaagtaaaaacaggaaagataaggacaataagattgtaaatttttaactattttttttactctaattacaacagaaacctgaatatatgcttataaatttgtaagtcagtttttagttatttaataaatctaattaagtaatcacaaatcaactaacaagatagttgaagtcagatatatgtatgtttatatttttttctcaaagtatgttctactatgttattcatgaagcattttgggttttttgagtatttaaatcaactaattttttatttaggtttgttttgtcatttatttgcactttaacaaaaaacaaatcttctatttcccagttaagtaaacatttaagtaatacaaatgaaaaaaaatagagttctgagaaatatgcaattgcgtaacagaagtcatatatgggctgactcataattgcaaagtaaaatctctgcaaaagtccttaacaagtgcatgtctttcatatttaaaatacaggctgagcatccctaatccgaaaatctgaaatctgaaatgctccaaaatctgaaatgttttgaacatggacatgatgagcaaaggaaatgctcattgtagtatttcagatttcagactcttggattaggggtactcaactggtaagtatataatgcaaatattccaaaatccgaaaaaagcctaaactcctaaatacttctgctcccagatattgtagataaaggatattcaagctataattaa

SEQ ID NO: 36 - DNA, 164034 bp, Homo sapiens
aagcttctgtgccttcggttcttttccttttcttttttaaaaaatttaattaattaattgattaatttttttgggacaagctctctatctcccaggctggagtgcagtggcgcaatcacgtctcactgcagccttgaccgtcagggctcaagtgactctctcacctcagtcccccaagtagctgggactacaggcatgggccaccatgcccagctaatttttatattttttgtagagacgggatttcatcatgttgcccaggctggtctcaaacttttgagctcaagcaatccgcctgcctcagcttcccaaagtgctgggattacaagcgtgagctgctacacctgacccaattatactttttttttttttttttttttttgagatggagtctcactctgttgcaaggctggagggcagtggcgcaatctcggctcactgcaacctacgcctcccgggttcaagtgattctcctgcctcagcctcccaagtagatgggactagaggcacgcaccaccaggcccagttaatttttgtatttttagtagagacagggtttcaccatgttggccacgatgatctcgatttcttgacctcgtgatttgcccacttcagcctcccaaagttacaggcatgagccactgtgcctggcctctatacttcttaagttattttaaaatgtgtaattaaattactattgactagagttgccgtgttttgctaccaaatactagatctcattcattctttttttttttgagatggagtctcgctctgtcgccctggctggagtgcagtggcgcgatcttggctcactgcaacctctgcctcctgggttcacaccattctcctgcctcagcctccggagtagctgggactacaggcgcccgccaccatgcccagctaatttttttgtattttttagtagagacagggtttcaccatgttggccaggatggtctcaatctcctgacctcgtgatccgcccgccttggcctcccaaagtgctgggattacaggcatgagccgccgcgcccgtcctcgttcattctattttttgtagccattaaccatccccggttctgtgcttttgaagcgctaggattccagattctttcttttaaaaattttatgtttattattttttctttatttcttttttcttttaattcatccatctgcacactgaaggggttccagattcttagtctcctctcgggggatcccagggggctggatggcaggtttcccagtctgagtcaagagtcagcccctgcagccctgtggtcaccaggagctcctgcaggatttagagtcaagggtctgcatgcagaccagggcagtgccagctacccccacacactggcaaacggtggcatctgggctccctccccagatgtggtctttagggacatcttatctccttgccagccctgtgactaccttctcagggcctccctgacttggtcactagccccaggtcaggcgccagcatgtgctaagtcagaaggaagtcaggcgggtctatggcggagagccaaggcttggggactcaccaccttgctgcttctctcctcaggatcttcatcatctgggccatcagcagttggttccgccgagggccggcccctcaggaccaggcgggccccggaggagccccacgcgtcgccagccgcaacctgttccccaaagacactttaatggtaactgccgggtggtagggcagacttgggaggtgatggggtgtggaggggtggaatgtggaggagtgatgtcagcagtcgggacagaccaggtccttgctcactggcaggtctaggaaaacaggtccagggttgaggaactctgggcccatccccaacacgtgagacctctgtcacctgggtccatccccagcacataaaacctgtgtcacccaaaagaaaaagcaaattcatttggttaaaataggttaaatcagggtctttggatgttatatttcaaaagtatgttcagcctttcagggttgcagagggagatgtgcaagggagagagtgtgagaggtggggagggcagggagccagcagaggctgacaggaggtgggcccggaaggagaggagacctgcacttccacagtgggcttgggcacaggcagggcagggcttcaggagcctccagagcaaaagcatttagatctgtcagtctaggcttttctgagcaaacatggccattggggcttgagaaaggaggaagttcttgttgggtcacagtgggtttttttttgttttttttttttttttgagatggagtctcactctgtcgcccaggctagagtgcagtggcataatcttagctcactgcaacctctgccttccgggctccagtgatcctcctgcctcagcctcacgactagctgggattacaggcatgtgccaccacgtccagctaattttttgtatttttagtagagatggggttttacctttttggctacgctggtctcgaactcctgacctcaagtggtctacccgccttggcctcccaacgtgctgggatcacaggcatgagccaccgtgcccggtggctcacagtgcttttgtagctctggactgcttcgtccataagcctgcagagctctgaccaggaaggcccagcagccatgagggcaggagatcattcagggagctcctgccccttcctacccctaaattctaattggcaggctggccagtctccaagtgttctttgttcgttgacttcacaggctcagaccaggacaaacatggtggtatgagaaaagagaaaatatgtcctctctgctgctcttcctctctcctctcccctgtcctccataattactgttcccctgagtgtgctgaccgctgccatagctctttagccagcctgcagaggctctgaagagcaggcctgagctctgttcccttcctgtcccaacagaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacaggtgggggcagctctcggtttctggccccatggctgcttgactggcactgaaggacctttcctccagtccgctccttgctgagagcatgtggagttcgggctccaggcttggcccttccctgggctcacatggtctgtgaccacaagccagtccctgagatctctgggcttcactttcccctacctgaaaaaggtagataggggtggaattggcctgggaccctcccagctacctctaaggttgtgcagtcctccactttaaactggtgaaagattagtaattgtccttggggatgtttgcctatcaccagtttatcaggcagccccgtttcaaaataatattagttaatgttgattgagctaagtgcagggtactaagctaggctgactcatggaaatttcccggcaaccctgtgaagcaggaactgttattattctcatttaacatgtgaggaaactgagacagagagaaggaaagtgatttacccaaggccacatcgcatgagagattcagactcaggctctacggctgtggactctcgcagccctaggctcaaatccaacctcctccaggaagccctccctgactcacagagcactcaggcttggttaagcaccctctctgggttctcacacctgctgggcttccccatcccagcccattctggggcctcattgggactcctgtatgggactgtgagccttgtgataataaggctggggctgcctagatcacttccatgtccccagcactgcccaacgtggggctgggtgcagaatcagcaagtattgaacaagtaaaagggacatctctctttggggccttcttcggctgagtccaagacagctgccctcattcctttctccccagcaggccttctcagctttggggtggagggcacatttctgttctatttctgtctgggtagctagaagcagaatgtggacacagtcattctggtttttttttttgttttttgtttttttttgagacagcgtctcgctctgtcacccagtctggagggcagtggcgcaaccttggctcactgcaacttcacctcccaggttcaagcgattctcatgtgccagcctcctgagtagctgggactaaggcacacatgatcacacccagctaatttttttattttttagtagagacaaggtttcactatgttggccaggttggccttgaactcctgacctcaagtgatccacctaccttggtctcccaaagtgctgggattacaggcgtgagacaccgcgtccagccatcattcttttctttttgagatggggtcttgctctgttgcctaggctgaagtgcagtggtgcaattacagctcactgcagcctcaacctcctgggctcaagcaatcttttcacctcagcctcccaagtagctgggacaacaggcatgcaccaccatgcccagctaattttttgtagagatggggtctcaacatgtttcccaggctggtctcaaactcctctgctcaagcgatcctctcacctcagcctctcaaagtgctggaattacaggcatgaaccaccccacctggctggactttctgacctgcactgagaggtgactcccacagagtcctcaagcccagcccccaggccttgccacgagatccaaggaaggaccagggcctggcaggcccagcagggggatctgcttccaagggcttggatctaagtcgaagcttcagggtggggtccaagtggacttaaaaggcaggagagctgggcacagtggcatgtgcctgtaggcacagctactcaggaggctgaggtgggagaatggccagagcccaggagtttaagactgtagtgtgccatgatcgcaactgcaaatagccagtgcactccagcctgggcaacacaggaagaccccatctctaaaaaagatagggagagtgaggagaacacaatgtggccaactgaattcgagctctgcacaaggatcagagaggttcagtgctcgcctttgtctccacccagtgcccctggacaacttgcctcccttcttgaagcctcagtttcctcatctggatcaagtgagaatagtcccccttccctgggaggcaaggagacttgatgagataatgaggaagacttgggcagagaggggccagctggaggtagcagggagtagcacccaggagcccacagactgggtttccatctgcgtacttgccacacactatgtgaccccttggcatgagccccgtttgcctcatctgcaaaatggggtggtaacatgacccattgcataaggttgacatgttatatgtgtgttaactcgttagattaggaagctgttgtctgaagtgcccagggcagggtctggcccatagtaggagctccatgtcggtcagctgcttcttcctgttgagtgagcttaacgagagctcgttgactgagctgtgtgccagtgctccaggtagtccctgcagtggtgccctcgggtcagtgctgtgggaacttcgcatcctctaggtggggccctgaggctcagagagaagctgagctcacacggccatggcaggtagagcgggcgtctgagtctgtctgactccagcatttacctctctgccacccagctacatgccccaccctgagtactcagtaaatggccagagagttgagggggaggaaactgctgcagatgggtgccaggcagggctttaacgtttccctcaccccagttgcccagcctgcccacctgaccttccgtcttttgcagagcgtccagcagaacggctccatctacatccacgtttacttcaccaagagtggcttccacccagacccccggcagaaggccctgtaccgccggcttgccacagtccacatgtcccggagtaagtcgctcccctgcagccaggacccactgtccaggaggccagcatcctgggagcccccaggctaatgtggcggacaaatcccaagtccaggagggcaggcaggaagcctgtgctcaaagagggtgggattggcagggcaggctcaagccccacccagcctgaaagagccctgtggacactaagcagggatacccacggaggaagggagacccacggaggctcagggaccagagagaaattggccagaaaaagcagctggagacagggactcttggagaggaggagacgtccttcaccaagggggaagggccagggttgacttttgcacagtaggggcctgatagaagtagacactcaaaaataatttgtgggctgggtgcagtggttcatgcctgtaatcctagcactttgggagacaaggtgggcagattgcttgagcccaggagtttgagaccagcctgggaaacatgacaaaaccctgtctctaccaaaaaagacacaaaaactagctgggcgtgtgcctgtagtcccagctgctcaggaggctgaggtgggaggatcgcttgagcccaggaggtggaggttgcagtgagccagaatcacaccactgcactccagcctgggtgacagaccgagaacctgtctcaaaaagatagatagaggccgggcacagtggctcacgcctgtaatcccaggactttgggaggccgaggcgggtgaatcacaaggtcaagagatagagaccatcctggccaacacggtgaaaccccgtctctactaaaaatacaaaaattagctgggtgtagtagcatgctcctgtagtcccagctacttgggaggctgaggcaggagaatcgcttgaatccaggaggcggaggttgcattgagctgagatcacgccattgcactccagcctggtgacacagcaagactccgtctccgtctcaaaaaaaaaaaaaaatagataaaattcaaagaacagtgtgggcaacataatgagacttcgttgctacaaaaattaatagccaggtatggtggtgagcacctgtggttccagctacatgggaggctgaggtgggaggatcgcttgaacctgggaggtcaaggatgcagtgagctgtgattgcactacagctttccagcctgggcgacagagcaagtccacgtctctgaaaaaacaatagtaataaaaaataagactaccacttctactcccatgataactcattaatccattaaaccactaatccatgaatgggttaatcagttcctgaggggagggtcctcatgacccagtcacctcttaaaagcctcatctctcagtactggcacattggggattaagtttcactgggagtggggagtactagagtacatcagtagtcccagctacttgggaggctgaggtgggagaatcagcatgagttttggccaggacaaacattcaaaccatagcattgtccgtcctcttgttttcgagaggttaataattgttgtcatctttctgcttgcctggctctttttttttttttttttgagacagggtctcactatgtcgcccaggctggagtgcagtggactatctcagctcaccacaatttccacctcccaagttcaagcgattctcccaccttagcctccaaaatagctgggactacaggcacacgccactacgcccggctagtttttgtatttttagtagagacggggtttcgccatgttggccaggctggtctcaaactcctgacctcaagtgatcgtctgcctcggcctcccaaagtgctgggattacaggtgtgagctgccacacccagccttgcttggttctctgtgagctttttccctgagtcctctgtctcctgatgggcagccgtagaaatctcttgctgtacctgtttgagcggagctggagaatggcttcctcagaaagccccccattcttctaacgggagttctgtgtactccacctagctttcactttattgaggactattccagacattccctgtggatttggttaagatccatctggctggttttgggtggcgcagcaacagacagaattctatttgtatgagttaggtcttacctacttcttttagtacaaaaatatcctaaaggatggtaatttttttttatcacctatactggatgaaatgaaaagttgactctatgtgggtccctagaaatgacttggaaaggtcttctggagttacttgagcccctttctgagtgagtgtgtctgcagaatgtgctgcgttggtatgtcccacccggctgacgtccatgtggtgagatctttggagaaccaggcagaagtggcttgagggggtgtgacctacagggttggtctcacagatgtttccctgcagggggatacgtcaggggtctgggctaaaatgcccgatgtttcagaggtcgctctgaaggtgacccaggtgggtggctcttcaccctattcttgtaccccgtttgacgatcacctaatcatcccgttgacccaaatcgatgccagtattttctgcagttttgtctttggtgagtgtgatccatgtcactgtgtggtgaggtttattcacagtcagtctggtctgtaaaatagaacctgcagacagtgaacctgaaaagcatactaggatcatccaggcctccctccccagccttggagctgggaccctcaaagcagggacatagaaggacttggagtgagccacccacaaactccagggtgaaggagagtgtgagttcagaaaagcccccttttggctggttgtggtggctcatgcctggaaacccagcactttgggaagccaaggcaagcagatcacttgaggtcaggacttcgagaccagcctggccaacatggtgaaaccctgtctctactaaaaatacaaaacttagctgggcatggtggcacatgcctgtaatcccagttactcgggaagctgaggtgggagaatcttttggaccccggaggcggagattgcagtgagccgagatcgtgccactgtactctagcctgggcgacagagcaagactccatctcaaaaaaaaaaaaaaaaaagaaaagaaaagccccttttatccccaagaggccaataatcagtattctagagcagctccgtcccatggagataggatgtgagccagagaaggcattaaaatttttccaatagaaaaatactaaagagtaaaaaggtaaagagaggccaggcacggtggctcatgcctgtagtcccagcactttgggaggccaaagtcagaggatcgcttgagcccaggagtttgaggccagccctggcaacatagggagacctcatctctacaaaaaaaaattttattttattttatttattttatttcattttatttatttattattatttttttttgagatggagtcttgctctgttgcccaggctggagtgcagtggtgcagtctcggctcactgcaagctctgcctcccgggttcacgccattctcctgcctcagcctcctgagtagctgggactacaggcgcccgccaccacgcccggctaatggtttttttgtatttttagtagagaccaggtttcaccgtgttagccaggatggtcttgatctcctgacctcgtgatccacccgccttggcctcccaaagcactgggattacaggcatgagccagcgcgcctggcctattttattttatttttttttgagacagagtttcactcttgttgcccaggctggagtacagtggcatgatcttggctcgccacagcctccacctcccaggttcaagcaattctgcctcagcctcccaagtagctgggattacagtcatgtgtcaccacgcccagctaattttgtatttatagtagagatagggtttctccatgttggtcaggctggtctcgaactcccgacctcaggggacccacctgccttggcctcccaaagtgttgggattacaggcgtgagccaaaaaatttttttaaattagccagatatggtggtgcgcaacctgtagtgtcctccgactcaggaggctcaggtagaaggatcatttgagtccaggaggtcaaggctgcagtgaactgtgatcaggccactgcacttcagcctgagcaacaaagcgagaccctgtctcaaaaagaaatataaataaaataataaaaaggtaaggccagggccgtgatggctcacacctgtaatcccagcactttgggaggccaaggctagaggattgcttgagcctaggagttcgagaccagcctgggcaacatggcaaaaccccccctaataaaaatacaaaaattagccaggcatggtggcacatgcctgtaatcccagctactcgggagcctgaggtaggaggatcacccaagcccaggaggttgaggctgcagtgatcacaccactgcactctagcctggataacaaaaggagaccctgtctcacaaataaataaataaaaaggtaaagaaaaaccatgagattaatatcaataatagtttaattgagctcaacatattctcgtttcaacatatgatcagtataaaaagtgagatattttacatttttgtttccccttgtgtcagttttcagaatctagtgtgtgtgactgggcacggtggctcacatctgtaatcccagcactttgggaggttgaggcaggtggatcacttgaggccaggagtttgagaccagcctggccaacataatgaaaccccagctatactaaaaatacaaaaattaggcgggcatggtggctaacgcttgtaattccgtctactcgggaggctgaggcaggagaatcacttgaacccagaaggcagaggttgcagtgagctgaaatcgtgccactgcactctagtctgggcgacagagcgagactatgtcaaaaaaaaaaaaaagggtctagcgtgtgttttatatcatagcacttcttggtttggaccagccatatttgcagtgcccagtagctgcatgtggccagcaaccctgatactggatggtgcagctctagaagattttcctccaagaaaggggggctttttcctccccacaggagccaggtccatctggtctggatgcctccaagctgcagaatgtgttctttgcctgagccaaagcctctctcccctgtgcctccccctccaccagccagcgctgccctctggggctctcccttccctggacagtctctgtcaggtgtggacacgattggggcatgtccccctggaattttctccaagtcaacccttgagtgttggtttctccccctggacacaggaggaagatccccaatgatttaataatcatagaaatgatgaggattggccaggtggctcaagcctgtagtcccagcaatttgagaggccgaggcaggtggatcacttgaggttagaatttgagaccagcctggccaacatggttaaactccgtctctactaaaaatacaaaaattgctggtcatggtggtggatgcctgtaatcccggctactcgggaggctgaggcaggagaattgcttgaacctaggaggcagaggttacagtgagctgaagtcatgccactgctctctagcctgggcaacagagtgagactccatctcaaaaaaaaaaaaaaaaatgaggatgacgtttctgctaataagcagtaggccctgggccaagaagtggtgaggcttttcttccttctttagggaagtgacatcactcaccagcatcccttagcttgtaggattcagagccaagattgcccccagagcccccgctgttggccaggtctctttcccctttccctgtctctccctggccccaggggacaggatagagacttgagggagggcagactgagttttccttcatagcataaggaagagctgaaaagtccccgggctcagtggctcacgcctgtcatcccagcactttgggagactgaggtgggcagatcacgaggccaggagattgagaccagcctgggcaacatggtgacaccctgtctctactaaaaatacaaaattagccgggcgtggtggtacacgcctgtagtcccagctacccaggaggctgaggtgggagaatagctggaacctgggagtcggaggttgcagtgagccaagatcacaccactgcactgcagcttggatgacagagcgagactctgtctcaaaaaaaaaaaaaaaaaaaaaaaaaaagaaaagaaaaaagaaaaatacttagcttcttttcgggccaggtgcggcagctcacacctgtaatcccagcactttgggaggccaaggtgggcagatcacgagatcaggagattgagacaatcctggctaacacagtgaaaccctgtctttactaaaaatacaaaaaattagcagagcctggtggcacacgcctgtaatcccagctacttgagaggctgaggcaggagaattgcttgaacccaggaggcggaggttgcagtgagccgagattgtgctactgcactccagcctgggtgacagagcgagactctgtctccagaaaaaaaacagaaacgtccccaggccagggcagaggttgggagatggagcgtgggcacgcacaagccccttcctccccggcagcatttgggacaacatggcagggggcctgtggccaactgggcctctgcgagaggaagtgaggccaactcctggctggggattcacagcctcaaagtgtttctcatcttggtttctcatgttggtggcttcaggccttttttggaaccgtctgctgcctctttatagtcatgtattcaactggtcatcaccgagcctgtgcaggcgccccatgtgtgttcaaacaggccctgcccctacccgcatttccgcacagagtttgcagactggttgcagggacagacagcaggcaggtaaaccactggctaagtggttttggatagtggtgaaatgttgtgaaggaaacaagctggcaggagaatgactgcataggctcattcagtggggtggccagggaagccctgtggaagaaggacattctgccagggacttgaatgccacggaggagccaggccacgaagattgtgtcagggcatgggttcctgggacacggggcagcacgcctgaaggccccgggttggcatgtttgagaagtggaaggtggtgagggttgagaggtcaccggggctacggtgagtgtctggggttccaaagctgcgggatgccatgatcagtcacttgtttttatttatttgtttgtttgttttctttttctttttgaaacggagtttcgctcttgttgcccaggctggagtgcaacagtgcgatctcagcttcctgtaacctccacctccctagttcaagcgattctcctgcctcagccttccgagtagctgggattacaggcacccgccaccacatccggctgatttttgtatttttattagagacggggggtttcaccatgctggccaggctggtctctaactcctgacctcaggggatctgcccgccccagcctcccaaagtgctgggattacagtgccctactgagctggggtttctgcctggggcatttggtgatggtggcgtccccatgatcatgaggaactgggattcgttgagatttggggaggcagttctggcattccaggtcacattgatctcagcaggtgagtgcaaggtggatgccaggagaccgtgagccgttgctggtgggcaggggtccgggctctggaggctgcaggtgccggcaggtctcacgtcccctcctttcccacctcccaaccacagtgatcaacaaatacaagcgcagacgatttcagaaaaccaagaacctgctgacaggagagacagaagcggacccagaaatgatcaaggtaaacgggcagggttgtcagggcctatagggaccaagccaggccattcacagctcatcccagaccactggggctgtcatctgtcaccaccactgaaccaccatgccggctcggtcatgccacctcccctccctgagcactgggctcctcctctgggaaatggggtcaggaggcagctgtctctcagggagtgaggaggatcccagacaaggttacctgagcctcttgccagcctgggaggggtctacatcacagtcccattgtcacatgaggacacttgctcagtctcagccggaagtggcaggccagggactctcacccacacagccaggccccagagcccaagctcagcctggctccaagcacacacacgagaatatggctttagtaggaactgcaggattcatagttgctgtcactcccggtgggctggggagccgggcagttaatctgtggttaacctgcagtgggcactaagagacttcctctctctgcgggtggtcctgtgttgggggggtggtccctgctcatggagctgaggccaccgtgcaagagtgtgtggagcctgctgtcatgaggctgggcttcgcagcctggcctaggatgccagccctgcctctacctctacctcggttttctacatgtggggtgggaggatcctgtcggtggccggaagggtcctgggtggcggaatctctaagcctagggaggagagccttctgccagcagttgctgtggtggctgatattctgctgccagggttgtcaggggagatggctcatgcctgttttcccagcattttgggaggccgaagcagaaggatcacttgagcccggaagttcaagatcagcccaggcagcatagtgagaccccatctcttccaaaaaagagaaaaaagaaagaaagaaaagaagctgtccatggtggctcacgcctctaatcccagcactttgggaggccgaggtgggaggatcgtgcttgagcccaggaattcgagaccagcttgggcagcatagtgagaccccatctcagaaaaaaaagaaagcaaagattaagattttctcgggaaccctggggaggaagtgtacagagagtgatagtccccgagcacttccacctgcctctgaggtccttccccccatgttgcctcagagggctgaggactatgggcctgtggaggtgatctcccattggcaccccaacatcaccatcaacatcgtggacgaccacacgccgtgggtgaagggcagtgtgccccctcccctggatcaatgtaagctccccagccctgccagctgcctgcagagcctttgagagggtgctcggggtccatctccttgtcttctcctggccctgtccccctgagagagctttccagggctccaccctcccaagctcccaccctgtcctatccccttcccatgtcctctccctctcccacaccaccacccctggggaccccaggactgacttctacacgccagcatcggtccgcaatcaagtgccatccagcccacaaactgttttcaaaaaatgtcttatcacttgccagcttttgaaattgaggcagtatcacttaaaagccacaatttctggcttattttataaaactgggttacatggtcacccacagggcagccgtgggctggagctgagccacagctgcccccttcagtggggacctgcctgccctttgcctcagtcccctctgctgaggtcaaggcgccctttagctcctcatggtgtggcctagaaatgtcccctgtcctccagtctctgtagaggggccctgttgggtctctccagacatctgaggcctgcgggtaccctggcctcctgcccgggccaaatggtgcccctgccccacgtgctgcagatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggcgatgagttgtacgagcagtcagatgaggagcaggactcggtgaaggtgagtgcggccggtgtgggcgggacttcccggtgccttcctgggcgcaagaggccaagaggaagtgtgccaggcctgggctgtgggacctcccgcctggtgctcctctgcccacagtttcacaacctcccaggtcccttctccacagtgaaaggaagtgggcacccagccctccagccctagatgactgggggtcctctccccaggctgttctgttggaccctttgggtccagacctgtcccttcctccttctgtcccagaccttgtgtccctggccctggctccaactctgtgtctctgccatctcactgggtcctgaaatgtcagcctgtgtctgtggcgtgaggctcggctttgcctcctgggctgtcgtcactgttgggtctctgctcctggctcccagtgtcccttcacccactccccgcagcactcccttggcctctgcctcttcccctagtgccatctccccgtctcttctgtctttgtgagtcgccctcctctctctccccatctgcccatctctgacccagtctcctcctggctggcccaccttcagcctccctctacaggcggccccaggggcagccctcgggacaaaagctagtgaaggtgctcctgggtggggacaggctgtgctcacatgtgtcccctgcaggtggccctgctggagaccaacccctacctgctggcgctcaccatcatcgtgtctatcgttcacagtgtcttcgagttcctggccttcaagaatggtaggaacaggaccccagggctagtgagaggctgtgcagggtgggggacaggacctgcccccttcctcctcccctccctccccacatgtcctccccctgcctggggtctctcagccccactctccagaggcctagtgagctggggaggggcagtggccccaaaactcccaacccagaaattcccacccaccgggtgtggagctgagggaggggctggcccgctggtggggcagaggccaggccaatactgccaggaagcagggctggggaactccagagccaagagcagggaagccccggagctgctcccgccaccctgcccggcaggctgcctgctgcgggaggccgcttagggctgagtggacggggcctgcccaagtgggaaggaggagcactgtcccccaaaggtccctaggttctaaggctgaccatactgatggccagcgtttgaggagaagcagccacatgccaggcactgtcctgggtaccctccccagtagctccttgagccctatgggagccagaggctcagggatgtcacttgcccagtcacacggttcctaaggggcagatggttccagccccaactctcatcttctaggccctgcaggccacttcttccttgcccagagcaccccagtctgaaggagtggcctgcggccctgtagctcccgcaggcggcaagaggaatgagtagtagtattcctggtattaagatgctattgccggcctggtggtggctctcgcctgtaatcccagcactttgggaggccaaggtgggaggatcacctaagccccggagtttgagaccagcctgggcaacaaagcgagattcgtttctacacaattttttttaagaattagctgggcatggcagcgcgtgcctatggtctcagctactcgggaggcttgggcctgaaaggtcaaggctgccgtgagccatgatcacaccactgaactccatcctaggcaacagagtgacaccctgttccaaaaaaaaggacgctcttgccattattgagaactaccatctggaagaatgcagtgtcatacgggcacaggagctggtgccgaccccagccagccatctaccagctgtcgctgggagacgggacccttctgcctaggagctggcttggctggggtccagtgagaaatgaggcacaagaaggctgtcctccccagtgtcatgcagcagggggcgcaggcctcacttggcaccagtgctgtgtggcctccctggtctaaggagaggcttgggcccaactgctcccacgagaacccaccagaaccctgtctccagacccattcttctcagttgggacaggggtcattctgatgggcaggggtgggtggggtgaggctatggagtgtgccagagctctgggatgtgggggagctctgggatgtgggggagctctgggatggggtagggtgcacatggaccagaattcacagccctcactccctgagtgcagagctggccctgactctgcaggactgcagacctggctccaccactgtgctacagacgtggtggctcagcctcctgtggctgcggttagatgctcagccgggcggggtcaagagaggggtgtccgtggtgagaccagggctcagagaggagcatgctgacatggatccttggcagcatctaggcggagcactggaaggagctccagactggagcccagggcccttttcagtttcctgagcatggctgtgagccagttccttcccggtgtcagggcaggggcctggaggaggtggtcttgaagtgcatgccacagatcttccttcccagggagggcgagctggcaccatggtgtggcacagaccccgcgtcccttcagattctgccatgccaggctgtttggcctcagggaagcagcttccctgaccagtccttagcacctggcacgtggtgagccctgtccatggcaccagtcaccgtcaccatcagtcaagggactgcaccttggggtgctgggtgctgacgtcctatgggagggctccaggggtgccgcctgtctggtgctctgggggtcacccaatgaatatgagagccttcctgggagagaggggtctcgttcagcacccctcctgaggacccagccccaccccagggtgtgaggatgcaggccaagggggcctgagggagctgcagtagggtctcagcacctcctcagcctcctggttcccccctaccccctgcgcacagatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccgggtaaggctggggcgccatgctgtctcgggagctgcaggggttgggagggggtagtgtggcccagctggaccctggagctggcccccgggggattcccagcaagtgcctcactcccaggactgaggggattttctcaccaggggattttttgggtcacacatggggcaggggaactgggaacggtggggaagggcaggggctggttctggcttgtggggtgggagccagcgtagcaactgaccatggcacccacctcatccacagctggaccgagagcacagggtggcaggaatcttcccccgcctatccttcaaggacaagtccacgtatatcgagtcctcgaccaaagtgtatgatgatgtgagtgtcctgcacagtgggcccctgggggtggtctccaggtacccacgtatccctgaggcacccggggccggccatctgtctgccggacccatgctttacagcctgtgccacatcctctgtgtcccccatctgccataactgcttcctgggcgagtccggagtccccagggctacctggaaattccccctgcccggcctgccagaccaggtgtggtgggtgagggcggggagcagggctgccaggcagggctgaggagctggctgacagccccaccctgtggccccacagatggcattccggtacctgtcctggatcctcttcccgctcctgggctgctatgccgtctacagtcttctgtacctggagcacaagggctggtactcctgggtgctcagcatgctctacggcttcctgctgaccttcggtgagcggtccggccgccccaggagagagcaggccccatgctgcgcagggctcacagccccagtgtaggagacagacccatccccagacagggacaacctagggtgggcagagctgggatatagggaggcccgagggcacacatggccccatctggggtcagagaggacttcagggaggacatgaacagtacgcttcagtcctcattctcagggggcctttgtgtcttgggaacaagtaaacaagtagggccaggtgcagtggctcacacctgttatcccaatgctttgggaggctgaggcaggaggatcacttgagcccaggaattcgtgaccagcctgggcaacttggcaagacccgatctctacaaaaaaacacagaaattattggggagtggtggtgcgtgcctgtagtcccagctacctgggaggctgaggtgggaggatcccttgagtccaggaggttgaagctgcagtgagccatgattacgccactgcactccagcctgggtgacagagtgagaccctgtctcaaaaaacaaaagaccgggtgaatcacagccaatagtgagtactgtgaagggcagagtggtgggaggatgcacattaataggggtccgggggcccctctgaggacaggacatttaaacagaggcctcagatatccagggagagagctgtgcggatgtgacagaaggccccaccagtgcagaggccgctggtagagtgtgcccaggtataggaagtggtagagtgtgcccaggtgtaggaagtggtgagggggctggtatggccagtgcagagtgcacaggggagaggtgggagaggccatccctctgctcatgggtgctctcactgcaggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacggtgaggcccggtgggcaggtgggagctcccaccggaacagggccctgaggcagtctttagggcccaggcctgagggggtgccacggccccagatggggtgctcagtctgagggggctcggccccgcccttgcatcacgccctctccacccaggcccacctggctgtggacgggccagcccgacctcacactgcctcccacccctctccagatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgatgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactcagcactgcccctcctcctcgtgccttccttcctctgttgccttggagaacagcttcaagcagggatgaggtggctttcctgggtctgggagagtgacctgcagggtacgggacgtgtaaaggtggggattgtgaccttgtgtcaagagccatacctggccgggcgcagtggctcacacctataatcccaacactttgggaggctgaagtggatggatcacttgaggtcaggagtttgggaccagtctggccaacatagtgaaaccctgtctctactaaaaataccaaaattaattgggaatgctggcaggcacctgtaatcacagatactcgagaggctgaggcaggagaatcatttgaactcgggaggcggaggctgcagtgagcccagatcacacactgcactccagcctggacaacacagcaagattccatctcaaaaaaaaaaaaaaaagccatacccgccaggccaggcctcttcctcacttctcgccctcccaccagccctctgagatttcattaactggcctcatttcagattgctggggaagctgcttgcagggagctcgctgccctataccctttcctgccagctgcccctgctgggtgcaggctggagcctgccatgtgcccgctgaatgtctcctaacccgacaccaccaggcagggccaagtacagctttcagccgggtcgccatgagcacctgccaccctgaggcctcagcacagcagttggggcacgctaaatgtgtgccattggctttttgcgctgacacccactcccaattttggggagcatgggggtgaaggctcagcctgcctgagtggcacctggttggctggctgtagcactctgtgagtgttggggtgtcatatcacatccccggggctgcctgtgctgacaacagaggtggcatgagttggatttcccatcccagcccctggtgctgggactcttcgcccactggataggtgagctgagcgaggcctctgtgttctgagggctggggaccctacattcccaggtttactgttttggggggtggtctcagcaacacttctgggatagggggcccaacgctgaggaccacaccaggttccttcaggctccagctgccaccccatattgcagagccagtcaggggatccatgaggccccagggagacgatggcaccctcggagccccataccacaggtccacaggccatggcagtctcccatccctcagggcagccatgggtctccattacccgccccccaactctataccattccatggatccccggtgcccttggaggaaccccagcctctgcaccatggcctgactgacaggctcctaggaaccccggaggtacagggctctgcagccccttgagactggtgggctctccagccacctggacttcctggcctcgtcacccctggttcttcctcctctcacagctccacgcccaagcctttgacaaggcccatcagctacccccacaactccctgggggtctcacctcttcattgggaccacctgctccacctgctccatgcccctccttaccctgtggtgttcttgctcagtgttctgtctggtcccctgtcccggtcctgccctccccacatcccattcacactctagctagcagctagaggaaactcttttttttctttgagacagaatcttgctctgttgcccaggctgtagtgtagtggtaggatctcagctcactgcaacctctgcctcctgggttcaagtgattctcctgtctcagcctcctgagtagctaggattacagacatgcaccaccacgcttggctaattttttgtatttttaatagagacgggatttcgccatgttggccaggctggtctcgacctcaagcaatctgcccacctcagcctcccaaagtgctgggattacagacatgaaccaccctgcccggcccagctagaggaaactttatagtttattctactaaagcacaaacctgaccctgcccagcccttgctcagaacctactgtgggtgcacagtgacctcaggagaaagcccaggctccttactggggactgagaccttggtgatggggacacttattaacccctgcatccagcctggtcttccccctacctggatcctgcccccaggcacacaacccctgtccacttctttttttctttgagagagtcttgcgttgtcccccaggctggagtgcagtggcacaatcacagccctgcagccttgacctgctggctcaagcgatcctcctgcctcagcctcccaactacctaggaccacaggcaagtgccactacgcctgcgtaattatttatttatttatttagtatttttatttattattattattttttgagatggagtctcactcttgttgcccaggctggagtgcagtggcacgatcttggctcactgcaacctccacctcccgggttcaagcgattcttctgcctcagcctcctgagtagctgggattacaggcacccaccatcacacccggctaatgtttgtatttttagtagagacagggtttcaccatcttggccagtctggtctcgaactcctgacattgtgatccacctgcctcggcctcccaaagtgctgggattacaagtgtgagccacagcacctggccgcctgcgtaatttttaaattttttgtagagttggggtctctcgatgttgccaaagctggtttcaaactcctggcctcaagcagtcctcccagctgggcctcccaaagtgctgggattacaggcctgagccatcacagctggcttatcccttctttatcttacccatgtgtcctccaagctgtggctccaatgctcactcctgtaggaagccctccctgactgccaagttctctggggtctctcatggcagccctgcccactgtgagtcatcactggggacaggttggtctcttccactggatggagccccgtgaggacatagccagacctgtcttgatcactgctgtgtccccagcatagggccaaacacagagaagccacgccaggaatatttaatgagtgcatgttgaacaaccccaacattcactttcccagacacatgaacacatccagaagtgtggacctcggtggggctcatattcagacactggagactgtgacaagcagtcaacaaatgtaacagctgaaccctgcccctgggtagtgccgtgtgctggggtgttttgtgtatacagccaggaccaagacagacccagacctgccgtcatggggctcacagcccagcagaaatcctgagcactgaggatatctgacatgtcctttttaatttttatttttatttatttacttttttttttttttttgagatggagtctcgctctgttgctcaggctggagtgcagtggcacgatctcggctcactgcagccttcgcctgtcgagttcaagcaattctcctgtctcagcctcctgagtagctgggactacaggcacctgctaccaagcccagctaacttttgtatttttagtagagacagagtttcacatttcaccatattggtcaggctggtctcgaactcctgacctcaagtgatctgcctgcctcggcctcccacagtgctgagattacaggcatgagccacggcgcctggctatcctttatttatttatttatttatttattgagacaaagtcttgctctgtcgcccaggctggagtgcagtggcgcgatctcggctcactgtaagctctgcctcccaggttcaagcaattcttctacctcagcctcctgaatagctgggattacaggagtgcgccaccacgtccagctaatttttgtatttttagtagagatggtattttaccatgttgatcaggctggtctcaaactcctgacctcatgatccacccgcctcagcctcacaaagtgctgggattacagacgtgagccactgtgcctggcccctttttatttatttgtgttctttttgagatggagtcactgtcacccaggctggagtgagtgcagtggcacgatctcacttcactgcaacctccgcctcctgggttcaagtgattctcctgcctcagcctcctgaatagctgggattataggtgcccgccaccacaccagctaatttttgtatttttagtagacatggggtttcaccatgttggccaggctggtcttgaactcctgacctcaggtgatctgcctgcctcagcctcccaaagtgttgggattacaggcatgagccaccgtgcctggccctgacatgtccttttagtcattcagcaaactttttttttttttttttttttttgagacagtctcactctgtcacctaggctggagtgcagtggcgtgatctcagctcactgcagcctccacttcctgggttcaagtgatcgtcctgcctcagcctccctagtagctgggactacaggcacatgccaccacacccagttagttttgtatttttagtagagacggggtttcaccacgttggccaggctggtcttgaactcctgacctcaggtgatccgcctgccttggcctcccaaagtgctgggattacaggcatgagccactgcacccagcctcaacaaacatttttgaggcctggcattggcaagaggcagagaggaatcaggagagcttctggtcctataacaattggagctgctatttgtcatccttatcataagccaagcactagtgtaagtgctgcatgtggttggcttcatccattacatttaatattattcagtgtcctcgtcaccttactggtccatcactctgccctcatctctacccctttcctgtcagtcactctgcaccagccttcttgctattccttaagcatgccatgcatgttcctaccacagggcctttgcacgtgctagcccctgtgctttgaacactctcccccagatatccacatgaatccctcacctcctttgactccctgttcaaatggcacctctcagaccctgatcttcctaacccaaactatcttccgaactccttctcgttatcctgctctatcctgtaatactgccatcaccatcagacataatatttgcttatctgttttccatctgtctcctcacttggatttccttgatggcaagggctttttgtctgctgtgtgccttgctatgtccctagcttttagagcagtgcctgacactgttacgctgtgtgtaataactgtaaattgaagagccaggcacagtggctcacgcctgtaatcccagcgctttgggaggttcgggcagaaggatcacttgaggctaggaggtcaagatcagcctgggcaacagcaaaatcccatgtcttaaataaaagaaagaagaccgggtgtggtggctcacgcctgtaatcccagcactttgggaggccaaggcaggcggatcacgaggtcaggagattgagaccatcctggctaacacggtgaaaccctgtctctactaaaactacaaaaaattagccaggcatggtggcgggcgcctgtagtcccagctactcgggaggctgaggagcagaatggcgtgaacccgggagtaggagcttgcagtgagccgagatcgcgccactgcactccagcctgggtggcagaggaagactccatctcaacaaaaaaaaaaaaagaaagaaatagggctgggcacagtggctcacgactgtaatcccagcactttgggaggccaagacaggcggatcacctgaggtcaggagttcaagaccagcctggacaacatggtgaaaccccatctctactaaaaaaaaaaaaaaaaaaagaaagaaagaaatgtagtcccagcactttgggaggctgaggtaggcagctcgcttgaatccaggagtttgagaccagcttgggcaacatggtgaaacctcatctctgctaaaaacacaaaaattaggccaggcatggtggcgcacacctgtggtcccagctcaccagctgtgtggcctcaggcaactgacttcatctctctgagcttcagtttcccgtctgtaaagtgggtctaataataggacggtcatgagtattaaataaaatgatgttaatagttagttgccctttggccaggtgcactggctcagcctaagcaacagatcctctctctacaaaaatagaaaacaggctgggcgcagtggctcatgcctgtagtcccagctacttgggaagctgaggcaggagaatcgcttgaacccgggaggcagagattgcagtgagctgagatcgcaccactgcactgcagcctgggtgacagagcgagactccatctctcaaaaaaaaaaagaaagaaaagaaaagaaaacattagccggatgcggtggtgtgtgcctgtagtcccagctactctggaggctgaggtgagaggatccccttagtccaggaggttgaggctgtggtgaaccatgttcctgccactgcactccaacctcggtgacagagtgacaccctgcctcaaaaaaaaaaaaaaagttcacatttgtatatagcacccacatgtgccaggccctgttctaagaattttgtgttttaaatatttgtgtctattaatttgtgtgaccttggagaaattaattttgccgggtttcagttttctcatctgctatgtggggatcaataacaccatatacttcacacaattgttgtgaacattcaacttacagagttatttctttttctttttgagacaaggtctcactctgtcacccaggctggagtgcaatagcgtcatcacagctcactgcagcctcaacctcccaggctcaagcaatcctcctgcctcggcctcccaaagtattggggttacaggtgtgagccaccgtgcctagccagaacacccaaattttatacaagcaaaggaaagacaacaaaccctgcatctgtggtctgagagcgcctggcatccaacttagaacctaatagatcacctagtcgttctcaggaatatgagaggcttaggaatgtgatctagccaaatggctgcccctctttcagcctgagtcccttctgcaataatcctatcatatgcttctggcgctggtgatagggatgagctcagggtttaggcacacagctcaggatgtatacggaggctacactgctgccattcgcagactgaataactgagcttttgagctcaaagtggtctgggctatttatgggtaactttcaggggctgcagggaggaacaaaccaataaataaaacatccatgcattcatccaataaacttttttttttttgagatgggagtctcgctctgttgcccaggctggagtgcagtggcacgatctcagctcactgcaacctccgcctcccaggttcaagctattctcctgcctcagcctccggagtagctggcattacaggcgcacaccaacacgcccagctaatttttgtatttttagtagagatgggatttcaccatgtcggtcaggctggtctcgaaatcctgacctcgtgatgtgcctgcctcggcctcccaaagtgctgagattacaggcatgaaccaccgcgcccggcctccaataaacatttattgggcacctacggtgttccaggcgctggtctaggcgttggggttacaacaacgcacaaaacataaattctgaagctgacacgctagctttaaacgttccttaaatatcttcatcctcaatttacggttgaggaaactgaggtgtagcgagaccttggaggtttccgaaatattattatggatggcaggtgtagagccctgccaacctctcgatcctgaagctccccttccagcctgagaaacggcaggttcaagtcccactgggagaccaaagcggggagcggctcagtttgccggcttgctcaatgggtaaggcgtgatggctctaagcaggcctcagttgtctcgtccagagcaatgggcagcgacgcctgcccaacccctcctgagcgcccagcctccctttcccggccggccccgcccccgcgatcacgtgacgcgtgggggttttcccgttccccaggcgtgacgtcacggcggggtgcagaccaatgggcgcgcaggccggcggcgccggggaattccgccgccccgcccccgcccgccgcccgcccggcccggccccgcgccccgcgcagccccgggcgccgcgcgtcctgcccggcctgcggccccagcccttgcgccgctcgtccgacccgcgatcgtccaccagaccgtgcctcccggccgcccggccggcccgcgtgcatgcttcggtctgggccagcctctgggccgtccgtccccactggccgggccatgccgagtcgccgcgtcgccagaccgccggctgcgccggagctgggggccttaggtaagcggggctggggttcaggagaggggtctggggcggggctggagatgcggggattctggcggtcccggagtagtctgggggttcctatgggagtctaagggtttcgcgggggcagagtgagggttcctgagacactgtattagggcgtaggaagaaggcagagggtgatgagggggtacggcccgaggttcgagcgaggcgtcccgctgtagagtgagagggggcggggcctgaccctgaggcaaagaagggggcgtggcctgactcagagaaggcggagcgaaagctgctcttgggcggtatcggggcggggccgggcccagagagggagaagaggggcgggatccgacccggactatgagaagagggccgggcctgactcaaaaaaggaagcagggccctacgctgaggggtgagggggcggggcctggccgtgagggcaggaagggggcggggcctgagttggccgaaagaaggggaaggggcggggcctgactctggccgagtggaggggaagggcctgttacccaaaaaagcagggcggggcccgacacagagaatgaggagggggtggggcttgcctccagacggagaagcggagccttgacattgaaaaaattaaaagtggtctgaccctgacaggaggatgtttttttttgtttgttttttgtttttttcttttgagatggagtctcgctctgtcgcccaggctggagtgcagtggcacgatctaggctcactgcaacctctgcctcccgggctcaagcagttctcctgcctcagccccccgagtagctggaattacaggtgcccgccaccacacccggctaatttttgtagttttactagagacggggtttcaccatgctggtcagactggcctcgaacttctgacctcaggtgatccgcacgcctcggcctctcaaagtgctgggattacaggtgtgagcccttgtgcccagcgggatggggactttttaaactgagattgagatggggtcccctccaggcccaactttaagggagaaaaggagcgggccctgagtgtgatgaagggtggggcgaaccacagaaactaaaggccaggacctgtccatgatttagctggtaagcctggccagacgcaggggggcagtcagggcgaggggcctgatccagaggggaagggctagaagaggaaggggtggggcttccttgggatattctctggtcctctggctgccccccatcacctcctgagacgtttctccttctctgcagggtcccccgacctctcctcactctcgctcgccgtttccaggagcacaggtgagcagccctccacagttcctgcccactcgctcatgcaggatgaggttgggaggactccacagagatgtctctgtttgggggttcacgaggtccacctcagctttctcctgacagggtgcatccctccctgccagttgagatgggccccctaggttttcttacctcttggactgttaagagcgtgacaggtggccgggcgcggtggctcacgcctgtagtcccagcactttgggaggccgaggcggacggatcacgaggtcaggagatcgagaccatcctggctaacacggtgaaaccccgtctctactgaaaatacaaaaacaaaattagccgggcgtggtggcgggctcctgtagtcccagctactcgggaggctgaggcaggagaatggcgtgaacctgggaggcggagcttgcagtgagccgagatcgcaccactgcactccagcctgggagacagagcgagactccgactcaaaaaaaaaaaaaaaaaaaaaaaaagcgtgacaggtaaatcttaccacctatccatgcgcaaaggcttctttagagattcactgtggcttagtagaaggtaatcactgccatcctgggctttggagctggggtttacatactgctgtcatcgcccctccctgtgtgaatgtctgcaagtcagttccccagttcaggcctcagttttcctcatctgtaagatggacagaataacagtgcctctctttcagggaaattgagagtattcaatgaattgatacaggtacactttccaagcagtatctggcacacagtaagggttcagtaagtgttaactgttagtggtataataataataacgataataattattattactagacagtctataacagtggttcatttttggtgtgtgtgtgggttttttttgtctgttttttgtgttttttttttttttttttttttttttgagacagagtctcgctgtgtcacccaggctggagtacattgatgcgattttgactcactgcaatctccacctcccgggttcagcaattctcctgcctcagcctcctgagtagctgggattacaggcacccgccaccacaacccactttgtgtctttagtagagatggggtttcaccatgttggccaggctggtcttgaactcctgacctcaggtaatccgcccgcctcagcctcccaaagtgctgggattacaggtgtgagccacctcgcctggccagacagtggttcttttttttttgagacggagtttcattcctgttgcccaggctggagtacaatggcgcgatctcggctcactgcaacctccacctctcaggttcgagcaattctcctgcctcagcctcccaagtagctgggattacagtcatgtgccaccacgctcagctaattttttgtatttttagtagagacagggtttctccatgttggtcaggctggtctcgaactcctgacctcaaaggatccgccctcctcggcctcccaaagtgctgggattacaggcgcgagccaccgtgcctggccagacagtggttcttaaaccatgtgcatcagaatcatccatagcgctagttaaaacataatgtcgcctgatgtggtggctcatgcctgtaatcccggcactttgggaggccgaggtaggctcatcacctgaggtcgggagttctagaccaggctgaccaacatggagaaacaccatctctactaaaaatacaaaattagctgggcgtggtggcgcatgcctgtaatcccaaatattcaggaggctgaggcaggagaatcacttgaacctgggaggtggaggttgccgtgagccgagatcatggcattgcactccagcctgggcaacaagagtgaaactccgtctcaaacaaacaaacaaaaaaacagccggccgtggtggctcactcctgtgatcccagcactttgggaggtcgagacaggcagatcacaaggtcaggagttcaagaccagcctggccaatatgttgaaaccccatctctactaaaaatacaaaaaaaattagccaggcgtggtggcaggcacctgtaatcccagctacttgggaggctgaggcaggagaatcacttgaacccgggaggcggaagttgcagtgagcggggatcgtgccactgcactccagcctgggtgacagagcaagagcctccgtctcaggaaaaaaaacaaaaaaccatgtcaggccccacctctcgagtttctgattcagtaggtttgggatgagaaattatttgcatttttagcaagctcccaagagatgcctagaactactagtctataaagtcccccagccaaaattcagtgctgcccaaggaaatgcagaatctcaaccaaattatgacattttttcttatatacatttgccaggatttggagggcaggggtagtcctgttgttatgaatactcagtggctccagttagctgggtctgggcctttctctggagatataatcttgggatggacccaagttctggcttggccattgaagaagtgaggccggttccccaacaggtctgtgagtttagggaggatggcatcagtgacagacactgcccaagcggtggtcctgcgcaggaacaaggctgagacttttcttttttttgagacagagtctcgctctgtcacccagcctggagtgtagtgtcacaatctcggctcactgcaacctccgcctcccaggttcaagtgattctcctgcctcagcctcccgagtagctgagattataggcgtgtgccaccatgtccacctaatttttgtatttttagtagagacggggttttgccatgttggccaggccggtctggaactcctggcctcaagcgatctgcctgccttggcctcccaaagtgctaggattacaggcatgagccaccgtgcccggccaaggctgagacttttctggtccaagacctagatctttggtttcaaatgagagttatttctgatgtcatccattcaataaatatttattatgcgcctgttctgtacctggccttgtgccgagcagtgctgaggacaggcctggccctggggttccctacctagatgaggaggcagacacgtaaacaataagttaaatatgggattataaaatgtgataagggctatgaagaaaccttggggtcaatgatatttaataacagggtggggatacgagaactagtgagatagaatgggaaggaaaattccctttttgtttttggaggcagagtctcattctgtcgcctacactggagtgcggtggcgtgatctaggcttactgcaacctccgactcccgggttcaagccatcctcctgcctcagcctctcaaacagctgggattccaggcgtgtgccaccacacgcagctgatttttgtacttttagagaaacggggtttcaccacgttggccaggcttgtctcaaaatcctgacctccactgatccagccacctcggcctctcaaagtgctgggattacaggcatgagccactgtgcccagcgagaaaatccccttcattgtgaagggccagacatatgctggaccctggggataaaatgaggagaaacagacattattcccactcttcaatgctcccagtctataggagacaggtatgagtcagtgtaatgtgaggtcatgtgacatcttcatcagcgccatgaaaatgataaaacaggctgggtgtggtggctcatgcctgtaatcccagcactttgggaggccgaggtgggtggatcacctgaggtcaggagttcaagaccagcctgaccaacgtggcaaaacctcatctctactaaaaatacgaaaattagctgggtgtggtggcctgtaatcccagctactcaggaggctgaggcaggagaatcacttgaacctgcgaggcggaggttgtggtgagctgagattgcatcattgcactccagcctgggtgacaacagcaaaactccatctgaaaaaaaaaaaaaaaaagaaaatgataaaacaaaggcacctgactttgagggactggagtgggggataaggggactctcttggataaaatggtcagggaagagctgtctaggatgtgacgtttgaccaaggaactgaagatggaggaggaggaagtcacgccatgcaaagaactgggggaagagcattcaggcagagaccagcctgtgcaaaggctgaggcagcacatacatagtcaatttcctgctctcacatctgctctcacgtggcccatcctggctgcccctgaatggtggcaagtccacgttgggggtaaagggaggcactgctatttgagcagaaacttgaataatttcctggctaatagaggacttgagataataataatattaactaagctttctggaagatgtcgcgtggtcagaacctgcactaagtagtttacctgtgtgattctgaatcctcatgttagttcctgaggtaggagctcacacctcattttgtagaggaagctcagagacggtaagtgacttgcccaaggctgcacagccagtgagtaacagctgagattcaaatcaactctatgtgactctacactccatgctctaaaatcatgcccatggccaggcgtggtggctcacacctgtaatcccagcactttgggaggctggggtgggtgggtcacttgaggccaggagttcgagaccagcctggccaacatggtgaaaccccgtctctactaaaagtacaaaaattagccgggcatggtggtacgagactgtaatcccagctactcaggaggctgaggcaggagaatcgctagaacccgggaggcagaggttgcagtgagccaagaatgcaccacactgtactccagcctgggtgacagagcaagactccatctcaaaaaatagaaaataggctgggcgtggtggctcacgcctgtaatcccagcactttaggaggccgaggtgcgcggatcatgaggtcaggagatcgagactagcctgactaacatagtaaaaccccgtctctgctaaaaatacaaaaaaaaaaaaaaaaaaaaaaagccgggtgtggtggtgtgcacctgtaatctcagctactcgggaggctgagacaggagaatcacttgaacccaggaggcagaggttgcagtgagccaagattgtgccactgcaccctagcctgggtgacagagcaagactccgtctcaaaaaaataaaaataaataaaataaaataaaataaaatattaaataaaagtatcttagcccaacaaggtaggcattattattgtgcccattttacagatgaagaagccaaggcacaaaaaggtgaagtaataggcttatggccccacaactagcaagttgcagagccaggatttgaacagaggcagtgaacccagagctccagccacagccgcccaggactcagtctccccctacagcccgggagcctctggagggtccaaagtctaactctgtctttgggtccccaggttcatccagcacagatgcctaagaaggattttcccagttcaagtgacttgaggttggccctgccactgacctagagcgtgtcccttcctctctgccagcctcagtatccccatctgccaaattggggggaccttggcaccctactggcttcacagatcccatgagataaggggtgcaggaaaactacctttcaaggggcaaaggtctggctgccaggagccactccctgagaacagaggaggacagatctagcagcggaacaggttcgcgtctataaatccccagccagagaccagcgcaggcagccctgggtgggacacctggctgcagctgccttccgttgctgtgtgattctaaggctcactggcggcctctgggcttccccttgtcctgtctatggaatgacgggaggtcggtttcgattcctccacgattctgtgaagggctgagctttcctggggaggtgaaaaggggcttccctgaggacccagcattactgtacctcctcacttaggaagcaggggtgaatctgggattttgggtggtcactgtgggaggacagggctggggtacagagcaagaggctgcctgggttcagatcagcctctttgcatctttttgttgttgttgttgtttgtttttgagacagtctcgctctgttgtccaggctggagtgcagtgacgcaatctcagctcactgcaacctctgcctcctgagttcaagcgattctcctgcctcagcctcccgagtagctgggattacaggtgcccaccacgatacccagctaatttttgtatttttagtagagacggggtttcgccatgttggccaggctggtctcgaactcctgacctcaagtgatctgcccacctcagcctcccaaagtgctgggattacaggcgtgagccaccaggcctggccacctctttgtatctttaaacaccagccagtgacctccaggaccctggggtggacttcagggagggaacacaccccaatttgtttggaaatttgggcatccactttttcctggtgctaagacccctttctaatgggttcccaaaaagacttcataatccctggtctaaatgtttttcgggaggcatttggcttagttggaggataccctgatgctgggaccccaacattagaggttgaaaggatggtagcccagaggagaagatgaggtttggggtttagtgccccagcaagtcagagcccagggtttcccaggacggaggaagacggaagggtcacaggagggacagggttggggaatctgtcttaaaagatgaaaagttgtgaccactttctggaccttacctttctctttctctttctcttccttccacagatgaattgggtgagtatcacagggcaggtttgcggggaggctgagggacccaagtgcctacagaagggggtcttggccttccttgttcagtgggggtgggggagaggtgtcactgtgtgacttccaggactgtggagggatttgaacgaagtcatgctcctaaggtacttagcagtgcttgacacttggaaaacactcagcacgccgggggctgtgtgactcacacctgtaatcctggcactttgggaggcagaggcaggaggactgcttgaggccaggagttcaggactagcctgggtaacatagtgagacccccatctctacacaaaatttttaaaaattagccgggcatggtggtgcgcacctgtagtcccagctgctcaggaggctgaagtgggaggatcacctgagcctgggaggttgccttggaagccgaggctgcagtgagctatgattgcaccactgcactgcagcctgggcggcagagcaagaccgtgtctcaaaaagaaaaccaattaaaataaaataatgttattaatcccctagtgagtacagacagacactgttttaggccctggggatttagccatgaacaaaaccaagtccctgccctcgcagagctgatagcccggtgtgggagacagaggaaaatgaacagatgagcaagataatgttagcctgggctgagagctgtgaaagaaataaacaggacgagggagagatggcctggagaagacacattaggttaggcttttctgaagagataacatacgagctgagaccaggaggagaagcagccagcatgggttgaatgggggaccgtgtggaacaggcagttggaggagcaagttctttcttatttatttatttaagttattttttgagacagagtctcgctctgtcgcccaggctggagtgcagtggtgctgtctcagctcactgcaacctccacctcccaggttcaagcaattctcctgcctcagcctcccgagtagctgggagtacaggcatgcaccaacatacctggctcatttttgtatttatttatctatttatttagagatggaatttcgctcttgttgcccaggctggagtgcaatggcatgatcttggctcactgcaacctccacctcccaggtttaagtgattctcctgcctctgcctcccgagtagctggaactgcaggcacacatcaccatgcccaatttttatatttttagtggagatggggtttcaccatgttcgccaggcaggtctcaaactcctgacctcaggtgatccgcctgcctcggcctcccaaagtgctgggattacaggcgtgagccaccatgcccagcctatttatttatttattattattattttttgagatggagtcttgctctgttgcgcaggatggagtgcagtgacgcaatctcggctcactgcaacctccgcctgacggtttcaagcgattctcctgcctcagcctcctgagttgctgggactacaggcacgtgccaccatgcctggctaattttttgtatttttagtagagacagggtttcactgtgttagccaggatggtctcgatctcctgacctcatgatccgcccgcctcggcctcccgaaatgctgggattacaggcatgagccaccgcgcccagcctattatttattgagagacggagtctcactctgtcgcccaggctggcgtgcagtgtcacgatcttgacttactgcagtgtccgcctcctgggttcaagctgttctcctgcctcagcctcctgagtagctgggattacagacgtgggagaccattcgggctaatttttgtagagacggggtttcactatgttggccaggctggtctcgaactcctgacctcaattgattcacccaccttggcctcccaaggtgttgggattacaggcgtgagccaccgcacctggcctccctgactctgtgtgtgtgtgtgtgtgtgtgtgtgtgtgtgtgtgtgtgtgagagagagagagagagagagagagagagagagagagataaatgggatggaaaacgtctcgggggtaatcaagcctttttttttttttttaattttttaaagaatgggcgtcaccacccgttttttcttctcccgcagagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgaggtgggcccggcgagcggccccgggcgggtgggactggggcttcccctgcaccccggagccatccacatgcatttatacgtttatttgatggtggctgttgttgttattgttggaccagatattaattatactatcacctggcctggaatccaaaaggttcagaaaaaaggaggggtcggacatttggctgggcacggtgactcgcgcctgtaatcccagtactttgggagtctgaggcgggcggatcccttgatgtcaggagttcgagaccagcctggccaacatggtgaaaccccatctgtactaaaagtacacaaattagccgagtgtggtggcacaatcccagctatttaggaggccgaggtgggaggattagctgagcccagggaggtgcaggctgctgtgagctgagattgcaccattgcatagcagtctgggtaacagagtgagaccttgtctcaaaaaaaaagaaaaaaaaaaaagaaggcagatcgtggtgcggtggctcaggcttgtaattctagcactttgggaggtcgaggcgagcggatcactcgagctcaggagttctagatgagcctgggcaagacggcaaaaccccatctctacaaaaaatacaaaaattagccaggtgtggtggcacatggctgtagtcctagctacatggtagggctgaggtgggaggatcgcttgagcctaggaggtcaaggctacagtgagccaagatcgcaccactgcactccagcctgagcaacagagcaataccctgcctccattaaaaaacaaacaaatatatataacactggaagtaaaaaaagcaaaggtgattacttttggcagggtattaatgtattaataaggtacaggtaagttttatttttttgagacggagtcttggtctgttgcccaggctggagtgcagtggtgtgatctcgcctcactgcaacctccacctcccgggttcaagcgattctcctgcctcagcctcccgagtagctgggattacaggtccaccaccacgcctggctaatttttgtatttcttagtagagaaggggttttgccatgttggccaggctggtctcaaacccctgacctcaagtgatccgcatgccttggccttccagagtgctgggattgcaggtgtgagccactgtgcctggcctctttggtgtctgttaatctggatctgttcttcaatctgtctttgtgtttcgtgagttgaacatttgtgcagaacaggacggatgttttgtagaatgtcccacattctgaagctggtcgtggtggctcatgcctgtaatcctagcactttgggaggccgaggcaggcggatcacctgaggtcgggagttcgagaccaccctgaccaacatggagaaaccccatgtctactgaaaatacaaaattagtgcggcgtggtggtgcatgcctgtaatcccagctactcgggaggctgaggcagaagaatcacttgaatccgggaggcagaggctgcggtgagccaagatcgtgccattgctctccggcctgagcgacaagagcaaaactccttctaaaaaaaagaaaaagaaaaagaaaaaaagaatatcccacattctgggtttgttggctgtttccagattaggtcagattatgcatttttggcagaaacactccagcagtgatgctgtggccttctcagtgtctcacatcaagggacgtgggatgtcgttattcccaatattggtgatgctgagttggatcctccagctaatgtggtgactatcaggtctctccatgataaagatacaactttccctttgtaatgaattggtaagttatctatgggatgatatactgagatgtatcatcccatgtttaactgtattccccaacttctaatttctaaggcttttttttttttttttttggagacagggtctctctctgtcacagaggctggagtaaagtggcacaagcacggctcactgcagcctccacctcccaggctcaagagaccctcccacctcagcctcctgagttgctgggactacaggtgcatgccaccgtgcctggctaatttttgtatttttttgaagagttggcatctcaccatgttgtccaggctggtcttgaacttctggcctcaagcaatcctcccactttggcctcccaaagtgttggaattacatgtgtgagccaccgcaccggcctaatttctaagtcttcccaggcagttattctggctcagagtttttttttgttttttggttttttttttgatggaatcttgctctgtcacccaggctggagtgcaatggtgcaatctcagctcacagcaacctccacctcctgggttcaagcgattctcctgcctcagcctcccaagtagctgggattacaggcacgcgccatgatgtccggctaatattttgtacttttagtagagatggggtttcaccatgttggccaggctggtcttgaacttctgaccccaagtgatctgtctgcctcagcctcccaaagtgctgggattacaggtgtgagccaccgtgctcggaccccagagttggttttgatttccaagatttagaatggtaaatgcctaaccatagggaatgacctgtctccaaatctggattcaggatttttttttttttttttgagacggagtcttgctctgttgcccaggctggagtgcagtggtgtgatctcagctcactgcaacttccgcctcctgggttcaagcgattctcctgtcttagcctcccaagtagctgggattacaggtgtgcaccaccatgcccagctaatttttgtatttttagtagagacagggtttcaccacattggccaggctgatgtcaaactcctgccctcaggtaatccacctgcctcggcctcccaaagtgctgggattacaggcatgagccagcatgcctggcttggattcaggatgtttatccccatcttcagagtaggaaactgaggttaaaagaggggcagttacctgcacagggcacacagcaagtttactattgtaattaccgccatttactgagtgcttccatgtaccaggtactttgcatacctattttacacataaagacagtaagacccgagaggtttatcttgtagatggccagtggtagagcctggatttggtgccaggtcggacttattctaaagcctaatgggccaggcatggtggctcatgcctgtgatcccagcaccttgggagactaaggcaggaggatcacttgaggccaggagttcaagaccagcccaggtgacatggcaagatgcccgtctctataaaaataaaaaaattagccaggcgtggtggcatgcgcctggggtcccagcaccatgggaggctgaatggggaggattgcttgagcctgggaagtggaggctgcagtgagccatggtcacaccactgcactccagtctgggtgacagagaaagatgctatctcaaaaaaaaaaaagaaaaaagaaacaactaaagtctaatgttttttccacagtcccaactgacatctcaaggatgaaaagctttcagccctggagtctgcatgagtccgagactgttgactctaagcttttcagaatctcctactattacagcggggagctggttaaatgaatggttttaaccctatctgacccagtgagatttgtagacaatattacctacctctattcacagtcactcccaaagtccatattttattttattttattattattttttttttgagatgcagtctcgctctgtcacccaggctggagtgcagtggcatgcaacctccgcctcctgagttcaagtgattctcctgcctcagcctcccgggtagctgagattacaggcacctgccagcaggcccggctaatttttgtgtttttagtagagacggggtttcaccatgttggccaggctggtctcgaactcctgacctcaagtgatctgcctgcctcagcctcccacagtgctgggattacaggcgtgagccaccgtgcctggccaaaactccatattttacaccaaactgtagtataaaagagaaagaaaaggaaattaatacagcatatataatcacatttatttcaatatgtaaacgccccacaggatatatgaggaaggtggcagttgtttgtgactatatataggctccttgttaatgccgtggccacaaatgcagcctgacccagctgcgcagacttagtgacttatatgtcacacgtgcagggttgcggttggtgaggggattttccaaagtggcgaacaactcttggtctaaacaattagtgtgctggttgcaatctttgaaaattcagtgggtattacagttatgggaaactccagcctgggtgacagagttagacctcgtctcaaaaaagaaaaaggaaaaacaattatgggaaagaatattattggtgtcaaacagagcaagggccaggtgtgatgcatgcctgtaagcccagatgtttgggagactaaagtggaagtattgcttgagtctgggaggcggaggttgcagtgagctgagatcgtgccattgcactccagcctgtgcgagatcctgtcttaaaaacaaacaaacaaacaaacaaacaaatccactcagcaacaatagagcaagtttctgggatctggtcattttaaacaggtttcttattgactcgaatctttggcaggatgttcagaaggcttgctggctgtgggatggctgtgcgggactgtccctggtattataaactgtccagcataactggtcctgtctacttgcggtagggtccacatcagtgtcaaccagccaccccccaaatcccatttttcccctagggggcagcactcccccactgagaccaatggttaatggtattttataggcttgggctttagaagttcagagcaggcttcagaaggtatttaatgccagcagggctgagccagtgactcaaagctgccaagtgggactggccctgcctaacggggctggtttttatttgctgctgcctgtggctgctgagcaaaaattctggcttcacttgctatatcttccttttttaaaaaagaaaaatctggggaggccgaggtgggcggaccacctgaggttaggagttcgaggccctggaggctgggatcgcaccactgcactccagcctgggcaacagagagaatctgtctaaaaaaaaaaaaaacaattctggaaatccgaaataatgtgatgtcttataattttaattgtgggctccaagtttttcctaatcttttacttggaaaaaaaagttttagttttttcctgtctagtttttctttttaagttttattgaggtataattgatgtaagaaaaattgcacatacttaatgtatacattttgatgaatttgttattattcctttttttttttttttgagacagagttttgctcttgttgcccaggctggagtgcaatggtgcgatctctgcctctcaggttcaagcagtcctcttgcctcagcctcctgagttggtaggattacaggcctgtaccatcatgcctggctaattttgtatttttagtagagagggggttttgccatgttgcccaggctggtctcgaactcctggcctcaggtgatccacccgcctcagcctcccaaagtgctgggattgcaggcacgaaccaccgtgcccagcccttttgattagtttggatgataaaagaatttaaacctagagaccaggcgcggtggctcacgcctgtaatcccagcattttgggaggccgaggcaggtggatcacctgaggtcaggagttcgagaccagcctggccaacatggagaaaccccatctatactaaaaatacaaaaattcttggccgagcgtggtggctcaggcctgtaatcccagcactttgggagactaaggcaggcagatcacaaggtcaggaggtggagaccatcctggctaacatggtgaaaccccgtctctactaaaaatacaaaaaattagccaggtgtggtggcgggcgcctatagtcccagctactcgagaggctgaggcaggagaatggcgtgaacccaggaggtggagcgtgcagtgagctgagatcgtgccactgcaccccagcctggccaacagagcgagactccatctcaaaaaagtaaaataaaataaaaatacaaaaattagccaggcatggtggcaggcacctgtaatcttagctacttagaaggtagagacgagaatggcttgaacctgggaggcaggggttgcagtgagctgagatcatgccattgcactccagcctgggcaacagagcaagactccatctcaaaaaaataaataaataagaatttaaacctacagaaaagttaaaaaataatacactgagtatctttgaaaggtgagtgcctgttatttatttatttttttttaattttttttgagacagagtttcgctcttgttgcccaggctgtagtgcaatggcgcgatctcggctcactgcaacttgtgcctcccaggttcaagcgattctcctgcctcagcctcccgagtagctgggattacagacatgtgccaccacgccctgctaattttgtatttttagtagagacggggtttctccatgtcggtcaggctggtctcgaattcctgacctcaggtgatccacccgccagattacaggcgtgagccaccgcgctcggctgaaagctagtgcctttcatctatattcaccagttgacattttgccacatctgctgtgtctctcattctgtctccgcacagccaaacatacacacacacagatacatacatttttgttttgttttgagacagggtcttgctctattgcccaggctggaatacagtgacgccatcacagctcactgaagcccggatctccagggttcaagcagttttcccatcttagcctcctgagtacctgggactacaggtgcattccaccacacctggctgatttttgtattttttgtagagatggggtctgcacatgttgcccaggctggtcttgaactcctgtgctgaagcaacccaccttccctggcctccaaaaagtgctgggattacaggtgtgagccaccacgcctggccgacacattgtttttttgatgactcatttacaaatgaattgtagccatcatgctacttcacccctaattccttcaggatgtatctcctaatcataagctcctctgtagctacaatctcattaatcacctctaggaaaattagtaatcccatcaaatcatgtaatatacagtccatatttcaatttcccaattgtttccaaaatgtgttttatagttgtttcttcctccttaatccaggatttaaccaaggatcatgttgcatttggttgtcctatctcattagtctctctccttctctctttatttatgtatttatgtatttatttattttttgagaaggagtcttgctttgtcacccaggctggagtgcaatggcacgatctgggcccaccgcaacctccatctccagggttcaagtgattctcctgcctcagcctcccgagtagctgggactacaggcatgtgccaccacgtgcggctaattttgtatttttagtagagacggtgtttctccatgttggtcagcctggtctcaaactcccgacctcagttgatccacccacctcggcctcctcaaactcccaacctcaggtgatccacccacctcggcctcctcaaactcccgacctcaggtgatcccccacctcggcctcccaaagcgtcgggattacaggcgtgagccactgtgcgcagcccttctctccttttttaaaaaaattaagatataattgatcatatatagttaagattaaagctctgaatttttacatataatgtatacatatgtagtttacacagtgtaactacctaccacccaggcacccaggtcacaatacatgatttattctctttctctctctctctttttttttttttcttttttgagacagggactttgtcacccaggctggagtgcagtgacgcaatctgggctcattgcaacttccacgtctcaggcttaagtgatcctcccacctcagcttccagagtagctgggattatagatgcctgtcaccacacctggctaatttttgtattttttatagagacggggttgcccaggctggtcttgaactcctggtctcaagcagtcctcccacctcaacctcccaaagtactgggattacaggcgtgagccactgtgcctggcccatcatttgttgtcttttaaccccaaatgtggcacccatcttttttttttttttttttttttgagacggagtctcgctctgtcgcccaggctggagtgcagtggcgcgatcttggctcactgcaagctccgcctcccgggttcacgccattcttctgcctcagcctcccaagtagctgggactacaggtgcccgccaccacgcccagctaattttttgtatttttagtagagatggggtttcaccatgttagccaggatggtctcgatctcctgacctcatgatctgcccgtctcagcctcccaaagtgctgggattacaggcgtgagccaccgcacccggccatggcacccatctttatagtcttccatgacactgaaattttcacgtggtggctcatgcctgtcatcccagcgctttaggaggccaaggcaggcagatcgcttgagttcaggagtttgagaccagcttgggcaatgtagcgaaactccgtctctactgaaaacacaaaaattagccaggcatggtagtgtgcgcctgtagtcccagctactcaggaggctgcggcaggagaatcccttgagcccggaggcggaggttgcagtgagctgagatctcccgccaccgcactctagcttaggtgatacagcgagaccctgtcacaaaaaaatttaaaaaaggccaggcacggtgactcacgcctgtaatcccagcactttgggaggccgaggcgggcggatcacgaggtcaggagatcgagaccatcctggcgaacacggtgaaaccccatctctactaaagatagaaaaaaattagccgggcatggtggtgggcacttgtagtctcagctactcgggaggctgaggcaggagaatggcgtgaacccgcaggcagagcttgcagtgagcggatccagcctgggcgacagagcgagactccatctcaaaaaaaaaaaaaaaaaaagcctgagtggcctaaaaaagcagcctgtagggcagatattatatgaggccccccagttcatcagttggaagcttctggtttaggatatcaaagtggcctttttttttttttttttttttgagaccgtcatattctgtcacccaggctggagtgcagtgtcaagaactcggctcactgcatcctccgcctcccaggttcaggcgattctcctgcctcagcctcccgagcaggtgggattacaggcatgcgccaccatgccgggctaatttttgtattttcagtagagactgggtttcaccatgttagccaggctggtctggaactcccgacctcaggtgatccgcccacctcggccttccaacgtgctgggattgcaggcgtgagccacctcgcccggcccaaagtggtcttaagcaaacacattccatcatcctggtcgcgggagaaggttggggagctcccaacagaggaccctagtggggagaggattggggagctgccaaggaaggccccaaggagtttggatggacgcaggcatcggtgatgggacccccaaagaggacttctcttcctgcagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacaggtacccaccccctgacctccgacctctcatccttgatcatggagattctaagcgactggaggccacccatgaaactttagagcagagggcagcttgggtaaaccctccccactgcctcttctaggtgggagacaggcctggggacagtggagggcctcacttaggcctggagccttgccacacacatattcacatacattttatccctattttgtagaggaagaaactgaggctcagagagggtaaggagcacagataattgatgacagagctgggatttgactgcagacctgacttaactgcaaggtctgttctttctcttactttacaattcatctttttttttttttttttgggacggagttttgctcttgttgcccaagctggagtgcaatggttcgatctcagctcactccaacctccacctcccggattcaagtgattctcctgccccagactcccgagtagctgagattacaggcatgcgacactacacccagcgaattttttggatttttagtagaaatggggtttcaccatgttgaccaggctggtctcgaactgctgaccttaggtgatcctcccagctcggcctcccaaagtgctgggattacaggcatgagccaccgtgccggccttttctttctttttaaaacagaagcactgtataacttttattttgcatatgtccacaaatgcttacacaacatacagtggctacatctaaaactttgagcattttttcatagtgcaaagagacagaaaggtagtgacacacttcactgtgttacactgactttgggtagagccctaaaggcagcacgcacttcagaggtagggctgagtattgctcacactcaggtctggaagatttaattttagaaatttttaaacttagtgaaaatataagttccgagagcagagatcttgtctcttacattccctgctgtattccgagtgtctggcatagtaactggcacatagtaggtgctcaggaaatatttgtggaatgaatgaatactgccatgttatgcaatttacagacccatcagtaatgggtgagagcacctgattctccacaacctcaccagcaccgagtattatgaaacattttgatttttgctattttgatgagtgccccaaaacaaaggcatcttcattggtgtttaatttgcagttttctttccttccttccttccttccttccttccttccttccttccgtccttctttctttctttctttcagacagagtctcgctctgtcgcccaggctggaatgcagtggcgcgatctcggctcactgcaagctctgcctcctgggttcaagtgattctcctgcctcagcctcgcaagtagctgggactgcaggcgcccaccaccacacccggctattttttttgtatttttagtacagacggggtttcgccgtgttagccaggatggttaccatctcctgacctcgtgatccgcccgcctcggcctcccaaagtgctgggattacaggtgtgagcccactgtgcccagcctcttttttttttttttttttttttttttttgagaccgagtctcactctgtcacccaggctggagtgcaatggcacgatctctgctcactgcaatctctgcctcctggattcaaacgattctcctgcctcagcctcccaggtagctgggattacaggcgccagccaccacacctggctaatttttgtatttttagtagagacggggtttcaccacgttggtcaggctgatctcaaaattctgaccttgtgacccacccgcctcggcctccaatttttgtatttttagtagagacggggtttcaccacgttggtcaggctgatctcaaaattctgaccttgtgacccacccgcctcggcctcccaaagtgctgggattacaggcgtgagccaccgcacctggccctgaagttttcttattttatttatttatttatttattttgagacggagtctcgctttgtcgcccaggctggagtgcagtggcgcgatctcggctcactgcaaactccgcctcccaggctcacgccattctcctgcctcagcctcccgagtagctgggactacaggcacccgccaccatgcctggctaatttttttgtatttttagtagaggcggggtttcaccgtgttagccaaggtggtctcgatctcctgacctcctgatctgcccgtatcggcctcccaaagtgatgggattacaggcgtgagccaccacgcccggcctgaagttttcctattaaagatgaagttggccagtgttctcacatggtaaagataaggcatgttctggatcttctcaagaacctttgacatgcttatttttattttttgagacagattcttgctctgtcgccaggctgaagtgcagtggcatgatctcatctctctgcaacctctacctcccgggctcaagcaattctcctgcctcagcctcctgagtagctgggattacaggtgtgcgccaccacacccagctaatttttgtatttttagtagagacagggcttcaccatgctggccaggatggtgtccctctcttgacctcgtgatctgcccaccttggcctcccaaagtgctgggattctacagatgtgagccaccacgtctggccaaaaggtttattttattttttattgtttgagatggtgtctaactctgttgcccaggctggagtgcagtggcacaatctcggctcactgcaacctctgcctcccgggttcaagtgattcttttgcctcagcctcccgagtagctgggattacaggcatgcactactatgtctgctaatttttgtatttttagtagagacagggtttcaccatgttggccatgctggtcttgaactactgacctcaagtgatcctcctgcctcggcctcccaaagtgctgggattacaggtgtgagccaccgcgctggccttctgagaggtttaaaccccagaccgtttctaatgctgggacccctgggcctgggatgtcagcccctgagagcctgagccccacagcagcatctgccagagccctcctgcaggttagggccacacttgcctgctcacgagcactcctctccctcccccgtcaccccctcagttttaacaacctgggcatccagtgtgtgaggaagaaggagattgaggctgccattgagcggaagattcaactgggcattgacccctacaacggtgagcaccccctgcctgacctgaccatcccgtcctcccaaaccccttgacttccgtgctcaccctggtcccctcaccactccaggccccaccgtctcctccagccccatcccttccccgttcccctgtaccccagagagggtctccacttcccaccctcagcctccccatatctcccccgacagctgggtccctgaagaaccatcaggaagtagacatgaatgtggtgaggatctgcttccaggcctcatatcgggaccagcagggacagatgcgccggatggatcctgtgctttccgagcccgtctatgacaagagtgagttgagagtgctgtggccgttaggattgcccttggctgcaggtgtcagaatgtcccgcttacagaggcatgaatggctcaggcgctgtggctcacgcctgtaatcccaacactttgggaggtcgaggtgggaggattgcttgagcccaggagttcaagaccagcctgggcaacttggcaaaaccctgtctctataaaaaatttaaaaattagctgggtggccaggcacggtggctcatgccggtaatcccagcactttgggaggccaaggcgggcaggtcacctgagaagtcaggagtttgagaccagcctggccaacatgccaaaaccctgtctactaaaaatacaaaaattagctgggcgcagtggcaggcgactataatcccagctactcaggaggctgaggcagaagaattgcttgaacccgggaggcggaggttgcagtgagccgagatcgcgtcactgcgctccagcctgtgcaacagagtgagattgcatctcaaaaaaaaaaaattagttgggcatggtgacatgcacctgtagtcccagctactttggaggctgaggtgggaagattgcttgagcccaggaggttgaggctgcagtgagctgtgatcatgccactgcagtccagcctgggcaacagagcaagtggtgaaatcctgtctctactaaaaatgcaaaaattagctgggcatggtggcacacgtctgtaatccctgctacctgggaggcggaggttgcagtgagctgagattgcaccactgcactccagcctgggcaatggagagggactccgtctcaaaaaacaagaaaaaaaaacatcaaacccaaaatggaatcttctagtgttgtagaatgaacaatctgtacaactataccaggcagcccaagggaagaggcagcataagtaataatctctctccctttctgagagagtgcattatattccacagaatcaccctggtagacttctgcttatttttcagtggccagagcttggtcccatggccactcctagttgcagggtggtctgggaaagcaagtgcttagatttttcaccctctatagagggatacaggcatagaagaggggactgggaataactggtaggttttagccaacccatagtgactgctgtaagcatcaaaatgggatattaattcagtcagggcatttatggatgcaagtgatagaatcccaacttagccgggcgaggtggcttacgcctgtaatcccagcactttgggaggacgaggtgggcagatcacgaggtcaggagatcgagaccatcctggctaacatggcgaaaccccgtctctactaaaaatccaaaaaaaaaattagccgggcgtcgtggcgggcgcctgtagtcccagctactcaggaggctgaggcaggagaatggcgtgaaccctggaggcggagcttgcagtgagccgagatcgcaccactgcactccagcccgggcaacagagcgagactccttctcaaaaaaaaaaaaaaagaatccttacttaaataggcttaagggggaaaaaagagaataagttattctatttgttctattaacgagaaaaaatgcagatgtagcatagtgcttcaggtctggctgcatccagggcctcagtgatgtcattagatatctgtctctttctgtctctcagctgttcttcctccatgttagaatccatgcttatatcctacctgcctggcacctctccccgactcccaaagctgcttttagcttctcttacctaatagctttgcttaaagtctcaggtctatctctcattggcctggttttggtcatttgctcctttttgacaaatcagctttggccagagggatgcactgctctgattggccaggtctggggcatgcgctcaattactgctgagctaggaagtgggctcagccctgcccaatcccagttactaagatgaggggtggtcccttgagggaaaattggaggctgttaaaagaagaggggtcaggactactagatggggaaaacaacaggtgtccactacatgattacagtctatcaaactctcctcaaggaaccttctctcacctgggaccccatcaactctccctgaggtctgagggtctcccttaaacattttttaaaaattatttttattatttttttttagagatagggtctcactctgttgcctaggcagtcatgcagtggtgcagtcatagcttactgcagcctgaactcctgggctcaagtgatcctcccagttcagcctcacaagtagctgagactacaggcatgtgccaccacacctggctaagttttatttttaaaactttgtagagctagagtctcaccatgttacccaggctggtccagaactcctgggctcaaacgatcctccctcctcggcccctcaagtgctggcattacaggtgtgagccatcatgcctggcaattttttttttcttttttgagagagatgggggtctgctatgttgcccaggctggtcttgaacttctggcctcacgtgatcttcctggctgggcccccaaaagtgctgggattacaggtgtgagctaccttgcctagcaaaggatcttcttttgttttgttatttttttgtttgtttgttttttgttttgagacggagttttcctctgtcacgatggagtgcagtggtgcaatctcagctccctgcaacccctgtctcctgggttcaagtgattcttctgcctcagcctcctgagtaactgggaccacacccagctaatttttgtatttttagtagagtcagggtttcaccatgttggccaggctggtctcaaactcctgacctcaagtgatccacctgcctcggcctcccaaagagctgggattacaggcgtgagccaccatgcccggcaaaagatcttcgttttggacagacactcaccgggcttcagcttgagggctggcgattgttcgttaaccccttctgtccgagtgacttctttctccacctggactatgggttccatgaggatcagatgccctgccttttcaattccctacgtctccagggccccggggatggcacccactgggtgcccagtaaggctttggtgactgaattctcgggattttttttaatacacttcttcctcttgctccttcccagaatccacaaacacatcagagctgcggatttgccgaattaacaaggaaagcgggccgtgcaccggtggcgaggagctctacttgctctgcgacaaggtgcagaaaggtgaggggcctggggcagcaagcttgggcagagcggggtctggcaacttggaggggtagccagggagcccgggaagatgaaaggatgagaaagagctggttaaccagggcaccagagtgcaagggtccagaacactgtctttgcagtcagacacagctgatgggttcattcactccctgagtcgccttctcacccgtctgcgtaggacgacagagactcgtctgtggtgacccatgctgcaagctaggcggtgccatcacagagctcacgacatgtccagaggactctgatgttaagggtggaattgcataaatgaacgctttacggtggttctgataagcgctatgggtaaagcaaataggacaggagaagcaactccacttcattcatctctgttcaaatggcccttcctcaaacaggcttttaaaaaaaaaagacagctggtcaccgtggctcaagcctgtaatcccagcaatttgggaggctgaggtgggtggatcacttgagctcaggagttcgagaccagcctgggcaacatggtgaaaacccatatctactaaaaatacaaaaatgagggctgggcgcagtggctcatgcctgcaatcccagcactttgggaggccaaggtgggcggatcacctgaggtcaggagttcgacaccagcctcccaacatggtgaaaccccatctctactaaaaaacacaaaaatgagctggttgtggtggcatacacctgtaatcccagctactcgggaggctgaggcaggagaatcgcttgaacctgggaggcagaggtttcagtgagccgagatcacgcctctgcactccagcctgggccacagagcaaagctctgtctcaaaaaaaagaaaaaaagaaagaaaagaaaaagacagctgggcacagcagctcatgcctgtaatcctagcacagttttggaggctgaggcgggcagatcacttgaactcaggagttcgagaccagcctgggcaacatggtgaaaccctgtctctacaaaaaataaaaaatttagcaggtgtggtagtgtgcacctgtagtcccagttacttgagaggctgaggtgggaggatcacttgagcccgggaggcggaggctgcagtgagccaagattgcaccactgctctccagccagggcgacagagacagaccctgtctcaaaaaatcaaaaccaaaaacaaaccggctgggctggtggctcatgcctgtaattctagcactttgggaggctgaggtgggaggatcacttgagcccaggagtttgagtccagtctgggcaacatagcaagcccccatctctacaaaaaaaagttctttttaattaaaaaatagccaggcattaggccggctgtggtggctcacacctgtaatcccaatactttgggaggccaaggtgggcgaatcacttatggtcaggagttcaaaaccagcatggccaacatggtgaaaccctgtctctactaaaaatataaaaattagctgggtgtggtggaacacacctgtaattccagctacttgggaggctgaggcacgagaatcacttgaacctgggaggcagaggttgcagtgagccgagatcatgccattgcacaccagcctgggcaacacagtgagactctgtctcaaaaaatgaaataaaatagccaggcatgttggggcatgtgcctgtagtcccagcacttgggaggctgaggtaggaggattgcttaagtgcaggagttggaggttacagtgagctatgatggtgccaccgcactgcagcctgggcaatagagcgagactctgtctcaaaatagaataaagtaaagtgaagaaactggttccagagatatctagtaacttccccaagttataacagagttggtagtgaagagttctagccttcctgggtttccatcttggctctaacacttgccagctgtgtgaccttggacaagtgacttcacctctctgtgccttcattttcgtctttatacaatacggtacctaatagtaccttcttcatagagttgttgtgtgacttagaggcaatctatatgtaactgacacatataaagtctcagtacatggaggtactgtgatgacgggcgatgcagtaagacaagaaaaataaatagcaggcagagtagcatcatgaatcctgactcttccgctaccagttgtgtgatgtctcaacactttcaagcctcagtttccgtttttgtttttttttttaagaaccaggctctcgctctgtctcttaaatagctgggaccacaggcgtgcgccaccatgcctggctaattttttaattttcttgtagagacaaggtcttgctgtgttggccagtctggtcttgaactcctggcctcaagtgatctgccagctttagcctcccaaagggctgggattacaggtgtgggccactatgcctggacaggcaccttttttctctgctgactgtgcctggtatccttttgccataacagatcatagctgtgagtatgactgtatgctgtcttgtgagtcctcttactgaaccacctgagggtgatcttgaggatccctggacatgagggggatattaattcttttgtttgtttgtttgaggcggagtcttgctctgtcccccaggctggagtgcagtggtgcgatcttggctcactgcaagctccgcctcccgggttcacgccattctcctgcctcagcctcctgagtagctgggactacaggcgcctgccaccatgcccggctaatttttttgtatttttagtagagacggggtttcaccatgttagccggggtagtctcgatctcctgacctcgtgatccgcctgcctcggcctcccaaagtgctgggattatgggcgtgagccaccgtgcctggcaagggggatattaattctacctacctcttaaattgttataaggattaaatgagataatatatataaaaatacataaaacaaggccgggtttggtggcttacatctgtaatcccagcactttgggaggccaaggcgggcagatcacgaggtcaggagagcgagaccatcctggccaacgtggtgaaaccccgtctctattaaaaatacaaacattagctgggcgtggttgcacatgcctataatcccagctactcgggagactgaggcaggagaattacttgaaccagggagttggaggttgcagtgagccgagatcatgccactgcacttcagcctggaggcagagtgagactccatctcaaaaacacacaaacaaaaaaaaaccaaaaataaaattagccgggcgtggtggcatatgcctgtaatcccagctattccggaggctgaggcaggagaattgcttgaacccgggaggcagaggttgcagtgagctgagatcgcgccattgcactccagcctgggcaacagagcaagactctcaaaaaaaaaaaattttaaaaagggggaatattagtcttgattttaggggaggctgggcaagttgggagcacagtggtccagatgtcctggcttagctgatgtcccccgtttcctgccagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatggtaactacagcaacccagggtgacccaccacctcggagactaggtctttggccttggggagaccccagtggggatgggaaagaggcagaactagaatgcaggctcagagctacaaagacagtgttcagatcctggctctgctgcttactggttgtgtgaccttggcctctctgagcctcattcttctgtgcaaaatggaaataatagtagctgtcctgtgacatttggagagtatttaatctttcctcccctcagcatcctgcacatgcccgggcctgtgctcggtattgctagagacacagcagtgaccagcacggcccctagctgtgtcctcatgaggcttatagtcctgaggataggggacagcctgtccctacagagtgatgaccagagtgggcaggactggaatgaagtgctcaagggctcacattgcccagagggggtacctgacccagctgtaggtgtcagggaatgcttcttggaggaggggacagctgagctgaggacaggaggatgactaagcagggaagttttctagggaaatagtgagagtggaggaagagtgctttaaacagctggaacagcaggtgcaaaggtcctgaggccggattgtgcctggggtgctccaggaacaacaaagaggccagtgtgtaggccgggcgcagtggctcatgcctgtaatcacagcactgtgggaggctgaggcaggcggatcacctgaggttaggagttcgagaccagcctgaacaacatggcgaaaccccgtctctactaaaaatacaaaaattagccgggcgtggtggtgggcgcctatagtcccagctactcgggaggctgaggcaggagaattgcttgaacccgggaggcagaggttgcagtgagccaagattgtgccattgcactccagcctgggcaacagagcaagactcactacaggcacccgccaccatgcccggctaattttagtatttttagtagagaccgggtttcgccgtgttggtcaggctggtctcggactcctgacctcaggtgatccgcccacttcagcctcccaaagtgctgggattgcaggagtgagccaccacgcccagccaagactccatctttaaaaaaaaaaaaaataggcctggcacagcagctcacacctgtaatcccaacacttcgggaggccaaggcaggcagatcacttgaggtcaggagttcaagaccagactggccaacatatagtgaaatcccatctctactaaaaaaatacaaaaattagctgggcgtggtggcgcacacctgtaatccctcctacttgggaagctgaggcaggagaatcacttgaacctggcaggcagaggttgcagtgagccaagaccgtgccactgcactccagcctggtcaacagagcaagactgtctctaaaaataaataaataaataaataaataaaggaattaattattattgatgaattacttcttgtgtgtccctggtatctccttaacagacagctacggcgtggacaagaagcggaaacgggggatgcccgacgtccttggggagctgaacagctctggtgtgtgccctctgcccctttccacccccatccccaggttctggggaggggacagctgaccccactgccctgtcccaccccaggctggggaggaagggctgtcggggaacaggggtcctcatctctgccttccctcagacccccatggcatcgagagcaaacggcggaagaaaaagccggccatcctggaccacttcctgcccaaccacggctcaggtgggtcccagctacacataagcccctgtcccctgggtgggcagagggtaagtggcagccctgcttttctggcctcttcacgccctccaagagcagccacaaggcgagtcactcagcacttagccagcaacatagagtagaaagaatgagggctttggagacagaatggaagttctgatctcttctgggccatttccttgctatgtgaacttcattaagttgttctacctctcagagcctcagggactcctttgaaaaggcccagtacatacttagctcagtggtgttttaaaatttgatctatttcttctttctttttttttttttttggagatggagtctcgctctgtcgcccagactgcagtgcagtggcatgatctcagctcactgcaacttctgcctcctgagttcaagcgattctcctgcttcaggctcccaagtagctgggactaaaggcatacaccaccacacctggctaatttttgtattttttagtagagacggtgttttaccacattggccaggctggtcctgaactcctgacctcaggtgatctgcttgcctcagcctcccaaagtgctgggattacaggcatgagccactgcatcccacctatgatcacatttaactgcatttacagcaaaacccaaaataacaggggcttcaacaggatagaacgttatttcttgtctcacatacatagtctgtagggactgaaagtggctcatgcctgtaatctcagcactttgggaggctgaggcaggtggactgcttcagtccaggagtttgagaccagcctggccaacgtggtaaaaccctgtttctactaaaaatacaaaaattagccgagtgtggtggtgcacacctgtagtcccagctacttggaggctgaggcagacaaatcacttgaacccaggaggtgaaggttgcagtgagccaagattgcaccactgcactttagcctgagcaacagaatgagacccttctcaaaacaacaacaacaacaacaacaaaacaggcctggcactgtggcttacgcctgtaatcccagcactttgggaggccaaggcaggtagatcacgaggtgaagagagagagaccatcctggccaacatggtgaaactccatctctactaaaaacacaaaaattagctggatgtggtggcacatgcctgtagtcccagctacttgggaggctgaggcaggagaatcatttgaacccaaaaggtggaggctgcagtgagccaagatggtgccactgtgttccagcctgtcaacagagcaagactccgtctcaaaaacaagaaacaaaaaacagtccataggtaggtgttccagggatggtctggtgactgcatgatcatcgagagaccgaggcttctgccattttcagttcgccaactcatggtgcaaggtggctgttgtagctccagccattacgcccacgttccagttagcagaccttagtcacatgatcacatcaggctgcaaggaaggctagaaaatagtcccttgtgtctctaaggtttgtcttgttccaaaaagagagtccctctttttttttgagatagtcttgccctgttgcctaggctggagtgcagtggcacaatctcagctcactgcaatgtccacctcccaggttcaagtgattctcctgcctcagcctcctgagtagctgggattacaggtgcccaccaccatgccctgctaatttttgtatttttgggagagaaggggtttcgccatgttggccgggctggtcttgaacttctgacctcaggtaatctgcccgcctcggcctgccaaagtgctgggattacaggcgtgagccaccatgcctggcctgagaatccctcttataatgaaactttttgatttgattgttattttttcttaagtccccattatgcctgagaatgacatttattttttctgacaattttgggactggtgacttcccaacttgtgtctcccatggtctggagatttcactttttgggttgtctctgtatgttggggggctttggaacctcttctcctttctcactctcagggaaaactctccacagctgtgtaggagcatggtttcaaccccagttccacaacagctgtgtgagccttccatttactttccctcagtgccttagtttacttattattaattatttttagagataaggtcttgctctgttgcccaggctggagtgcagtggtgtgatcatacttcgctgcagcctcaaactgggctcaagcaatcctcctgcctcagactgccaggtagctgggactacaggcgggcaccaccacacccagctaacttttaaataatttttttgtagagacagggtctcgtcacgttgtgctgggattacaggtgtgaaccaccacgcttggccttcaatttacttattatctgagaatggtgatagtcccacacggattctccttgggattaagagggcacctaaggccaggcttggtggctcacacctgtaatcccagcactttgggaggccgaagcaggtggatcacctgaggtcaggagttcgagaccagcctggcaaacatggtgaaaccccgtctctactaaaaagataagaattagctgggcatggcacatgcctggcctgtagttccagctactcaggagactgaggcaggggaatcaacttgaactggggaggcagaggttgcagtgagccaagagcacgtcattgcactccagccagggtgacagaatgagactccatctcagaaaaaaaaaaaaaaaggccaccttgatatcacattttgcagggagtagggcatttgatttagggcctgatcagaagttagccctaaatcacactacacttctcttgtcttcatccccgtaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttcagagtcttcccaataaagatgagtttttgagcctccggggtttcgtctgttctgggcttgggaaacgccctagtcccttagtagcaaagaaagcctccaggctgggggctcaggcctgtcatcccagcactttgggaggccaaagcaggaggatcgcttgagctcacgagtttgagaccagcctgggcaacatgacgaaacctagtctctacaaaaaatacaaaaattagccgggcgtggtgctgcgcgcctgtaatcccagctactctagaggctgaggtgggaggatcgcttgagcccaggaggtggacgttgcagtgagccaagaccgcaccactgcactccagcttgggcgacagcgcgaggctgtgtctcaaaaaaataaaaaatgaaaatgaaaataaaaaatgagaccgggcatggtggctcatggctgtaatcccagcactttgggaggccgaggcaggtggatcacctgaggtcaggagtttgagaccagcctaaccaaaatggtgaaaccccatctctactaaaaatacaaaaattagccgggcttggtggcgcgcgcttgtagtcccagctactcgggaggctgaggtgggagaatagctgaaacccaggaggcaaaggttgcagtgagcctagatcgcgccactgccttctagcctgggagacaaagagagactccgtctcaaaaaaataaaattaaataaataaataaaataaaaaagataaaaagataaagcatccaagctcttcccttctccgctctcccacttcttcctcgggatcccgcccctctcgactctaggacccgcctctctcgtcggcggaagtgcgctgcgcggccctccaccatgctccgccccctccccctagcgcggcctttcatttccgcttccggtgcgggccgcgcgcgagcgcagcggtgggaggcggcgaccagccggtgagtgcaggctgcggctcgacctcccggttttcgggcaggcctcagcccagcttctccctttcctcaggctctccccatgctgctgtgggcttctgctgcgtcccggccccgaggatcgctcgtccctcaccccattaggcctgacgggcctcaggccgagcccgtgccccggctgtgggccagaagttgccgcgtcgaactcggccttcggcccagcagcttatcacaggccccgcccccttgtcaaaaaaaaaaacaacaaaaaaaaaacccagcccaaatcctcaggccgcgacgcgatccacaagccccgtccaaaccttcggtctccgccctttcccgcaagccctgcccccaagctcagcccacgccctcctgtcagccagctccgcctctctcaggctctacgctctttttctttggatgctctccccaccccgccatctagatcccatctttagacctcagcttcactctggtctccttgcaacactccctccccgtgttcccactccctctagcatcttcatcttccgccacgcccttcacctgtcctcgacctccaccttcatacaactgcactgttcccttaaaagctttctccgatttcctccacctgccttcatccttattctccttatccctctaccacccagactcatacccaaccccacgcatggcccctagtgggagccttttcagttcttctctttctcttgagctccagccttaagtgctcagggtttgccttctgaccctacttcaaacactgctgatgtttcaaaacctttcattcccgactccagcgcgtggaatctaggacacccctttcccagtgatgctcacctcagaatcacctgagggtttttcagaatgcccaagcttctagatcgaagttgttagggatggacttgaacatctggcatactgttctgcagcttcacttctgctccctgaagctaagagatgtgttgtttgggatcgactctgccaccaacttgttagatgactttgattctgcccatacgggtttcacagaccatctgactttcctggtcccttcatccctcaggttgaggccccaggcttggcctcaccacaatgtggcacgaggctcggaagcatgagcggaagcttcgaggcatgatggtcgactacaagaagagggcggagcggagacgggagtattatgaaaagatcgtgagtaactggccttttgtctggggtgagggaccctgggttggggggcacagctggtcatcctggtaaaatctgggcttggaagtatgtcaagacaagaggctcatttcctcaggagtatattcattaatcttttcttgaggataatcattggtgggatcccaagggcttctgtttgttgtagcatactgtgtcgtttggtgtggcctcccagtgccgatccggtgttagcaagaaaaagggaagtctctgtaaccctcagagcagtcctgacgttagactggccacctccagaatgtctgtttcgcttattgctgtgttccccattcccagaagagctcagccactcttgagatttggcttggcacacaataggagtgagtattaagttggcctggcacagtggctcacgcctgtaatcccaagtggatcacctgaggtcacgagttcgagaccagcctggccaaaagggtgaaaccccatctctactaaagatacaaaaattagccaggcttagtggtgtgtgcatgtagtcccagctacttgggaggctgacgcacgagaattgcttgagcccgggaggaggaggctgtagtgcatggagattgtgccactgaactccagcctgggtgacagagcaagactcaacgcctgtaatcccagcactttgggaggccgaggtggacagatcacaaggtcaagagatcgagaccgtcctggctaacacggtgaaaccccatctctattaaaatacaaaaaattagccaggtgaggtggcgggtgcctgtagtcccagctactcgggaggctgaggcaggagaatggtgtgaaccggggaggggggcagagcggagcctgcagtgagctgagatagcaccattgcactccagcctgggcgacagcgagactctgtctcaaaaaaaaaaaaaaaaagactgtctcaaaaaaaaaggagtgaatattaagtgaaacctgaccacttccctctcctgtctgatgcttcagttgtttttgcggggaagaccaaactatccctggcctaaaagacccttgtggtctgaccactcagcttcatactcggacagctccactggccttctatttctgccaccacagggctttggcctatattaccccccctcacctatttaactcctgtgtatccttgggatcccagcttgaaatggcacctgttttctaggttcagtgttcctgtcagatgacatttatatagacctttcccagttattcctgtattactgccccagcctcctccctggtctgctggcctccagtcctggctcctccagtctgtccttcctagaagagtccaagaggcctttctaaagcacaaaactgaccctgtcccttcgttgctcagagcacctctatgcctcctaagtgcccttgagagaaagcccaggctcctcactgtggcctttagggtcctgcatggcctggcctttgcccttcctccagactcacaccaccccacactctgccttgttcctttgcacaagtcattttggcctccttgctattcctccactgacccaagcgctccccagccacaggacctttgtatgagctcttcccatacctggttaactactgcttatctgtcagatctcagtcctcagagaagtcttgtttcccaagctcagtcaggtgtcctctaaaaatgccataatcatagctccctttccttcccctttgtggaatttaacacacttaagatacacatacatgggcctggtgtggtggctcacgcctgtaatcccagcattttgggggccaaggcaggtggatcacctcaggtcaagagtttgagaccagcctggctaacatgatgaaacctcgtctctactaaaaatacagaaattagctggaggtggtgaggagcctgggctttctctcaagggcacttaggagccatagaggtgctctgagcaatgaagggacagggtcagttttgtgctttagaaaggcctcctggactcttctagggaggacagactggaggagccaggactggaggccagcagaccagggaagaggctggggcagtaatacaggagtaaatggtaatcccagctactcgggaggctgaggcaggagaattgcttgaacccgggaggcataggttgcattgctctccagcctgggcaacagagtgagactccatctcaaaaaaaaaatttatatatatatatatatgtgtgtgtatgtatgtatacacacacgcacacacatacgcatacacaggttgaacatccctaattcaaaatccgaaatgctccaaaatctttttttttttttgaggcagagtcttgcttagtcgcccaggctggagtgcagtggcatgatgtcagctcactgtaacgtccaccccccaggttcaagctattctcctgcctcactcaacctcctgagtagctggaattacaggcatgtgccactatgcctggctaatttttgcacttttggtagagacagggtttcaccatgttggtcaggctagtcttgaactcccgacctcaagtgatttgcttgcctcggcctcccaaagtgctgggattacaggcgtgagccaccacgcccggctagctccaaaatctgaaactttctgcatactgacatgatgccccactataagtggaaagtttcacatataagtactttacacaaactttgtttcatgcacaaaattatttaaaatattgtatacaattaccttcaggctgtgcttataaagtataaatgaatttggtctttggacttgggtgccatccctaagatatctcattatgaatagacaaatattccaaaatctgaaaaaatctgaagcacctctgatcccaagcacttcagataaggaatactttgtgtgtgtgtgtgtgtgtgtgtgtgtgtgtgtgtgtgtgtcccgtctctactacaaatacaaaaaattagctgggcgtggtggtgggcacctgtactcccagctactcgggaggctgaggcaggagaatggcatgaacccgggagacagagcttgcagtgagccgagatagtgccactgcactccagcctgggcgacagagcgagactccgtcccaaaaaaaaaaaaaaaaaaaaaaattttttccattcatacgtatatgcacatacccagctctgtgagactggggactaattatatttgggtcacgtttgtaccctagggttgggtccatcaaatatggtttgaaagaatagatgaataaaacaatattaacaatagtaattaaccatttaattgatccttcgcaggcacccccaggccatgtgagagatgcaggattttttttgaatccccacagtcacctgtgagacagagaccgctcttacttccactcagcagagaagaggaagctctgagagctccttgcttacctctgccacccaggaaggaaccacggggctaaagggagaactcatctccgatagtgtcagaaagatgtgatcatcaaggcaaggcctgggtctctgttggtcatagttgaggccccagaagtggcctaggaacacagcactcaggaatgaatagctaccttttttttttttgagatggagtctggctctgtcgcccaggctggagtgcagtggcacgatctcggctcagtgcaacctccgcctcccgggttcaagcaattctcctgccttagcctcccaagcagctgagactataggtgcccaccaccacgcccggctaatttttgtatttttagtagagacagggtttcaccatattggccaggctggtctcaaactcctgactgcaagtgatccgcctgccttggcttcccaaagcgctgggattataggcgtgagccaccacacccagcctagctgccatttattaagggcccatggtgcgccagacccagtgctcaccagcttggcatagtagtcctctgaacaggcctgcgaggtaggtattgatcatgcctgtgttaaaggtgatgccacgataacagctaacgctgttgggcagttctgtggtaaccactgtgctaactacttggcttgtgtctccgcttcatcaaagccacacccaagactaggaggtggttcttactatttccattttacagaggacaaaactggagcacggagatacgtggcttacagtcacatagcatgagggcagagctggcactataacccagtctctgacccttaacctctctaagcttttcacctgcgccttatcatgcagaaatagaggttcaaaaagatgaggcatagcaagaccccatctctgcaaaaaataataaaaaaaaattagccaggtttggtggcatgcgcctgtggtcccagctacttgggaggctgaggcaagatgagacctgggagggtggggctacagtgagctgtgattgcaccactgcactggaacctgggtgacagagtgagaccctgtctcaaaaaagaaaggtgaggtgacttgcccaaggcaacacagccaggaggtgagatcccatcatggttagtccttagaatttgggagtcatggggctctgggttcaaattctagcgatcccacttatctatagtgtgacgtgggcaagtgactgcctccctgagcccatttcctcttccacatgtgaaaggatgtcacatggacaatcagctttggctctaacaaacctagagcatccgtcagtggcttaaacaagatagatgtttatttcttagccacagaaaagccaagaggtaaccagttagctcggggacctaagccgcttctgttttgttctcctgggcacagcttctcttcctagtgttgcatcgaggtctaagaggctctggccatcatgtcttcattctatccagcagggaggaaaaagggaggaaaaggggcaaagcgctcatgccatttgttgagaaagtttctaggccaggtgcagtggctcacgcctgtaatcccagcacttcgggaggccgaggcaggaggactgcttgagcccaggagttcgagaacagcctggacaacatggtgaaaccccgtctataccaaaatatacaaaaattagccgggcatgatggcgtgcatctgtggtcccagctcctcaagaggctgaggtgggagaatctcttgaacccaggaggtggaggctgcagtgagctgtgattgtaccactgcactccagcctgagtgggagaataagaccctgtctttaaaaaaaaagtttcgggatgttttcccgtaacatttccactcctcccctgctgaccaggaagtagtcttatgaacagccgtgaggaaggctaagaggtgtagactttattttgggtcgccctgaccagatatatttggagttctgttactgttgtagcaaagggaatagatgttggttgccaattaatggtttgccactaacagtggagacaagagcatgtccttcgatgttgttggagtgttggacacatggaccactgagagcagcctggccagcgtcgctatcgctcagtaaatattagctcttgttattgacattactgttgctgatagaactggagtttggatccaggtggagggatggtgcagaggaaggaaggctggagctgagactccaggccccctccctgttagcagggaagcttgctgcattgtattccccctcaggacagtggtgacgaccaacccctctcactggataatggggaagagctcaaagaaccaatgtctatgggtgctttgtggtgcaggcctgtacaagcggcctttgtccctgtatgtgaacgtgacctgcattccgatctgggctgccaagctgtggagtatggctgggccgtggctgatggctgctttgaggaggggactctcatctcagccttgggccgagagcagaggctgtggagcgagtgtcagtgaagctgcggtagattgtggcaggctgaatgagtatgtccagatgcagttggtttctgtcttcctgatttgtcgttggtgcctgctttctctccctgtcttcagtcccaagcagactccggttctgtcattgcttctgtccttgtcaactttcctttttaatcagtggtttggataaagaaacagaatcctctgttgatacggaaataagaagtaaacaggtcgcagctcaggcgtcgcctcctccaggaagctccagactgacccccaagtctgggtcaggtgttccccctgtgggcccccatctcagcgctgtccactctaggttgtccttgtatggggacaagtctgtgtcccacactggactgtgagcccatgagggcagggccagggctatctcagttactgccataccctagcacaaggtctgcttaacagttgaatgaatgaatgaatgaatgagtaacttcatgaactcctctgacacaatctgatcctagagacaggataatccagtggttaagagttggttttgggccgggcgcggtagctcacgcctgtaatcccaacactttgggaggctgaggtgagcagatcacctgaggtcaggagtttgagaccagcctgaccaacatggagaaacgtcatctctactaaaaatacaaaattagctgggcgttgtggcacatgcctgcagttccagctacctgggaggctgaggcaggagaatcgcttgaacccgggaggcagagattgtggttagcctagatcacgccattgcagcccagcctggacaacaagagcaaaactctgtctccaaaaaaaaaagtggattttggatcttgaagaggtacttatacacttatgttcattacagcattattagcaatagccaagaggtggacgcaagctaaatgtccattgagggatacatcgagaaagaaaatgtggtctctacacataacgcaatattattcaatcttaaaaaagaaagaaatcctgtcctatgctacaatatcgatgagccctgaagatgttatgctaagtgaaataagccagtcgcaaaaagacagtattgtatgatccgctgataagtatctaaaatagttaaaccttgcttgagcccaggagttccaggctgcagtgaactgtgatcacaccactgtactccagcctgggtgacagagcaagactccatctcaaaaaaaaaaaaaaaaaaaacagagagagagaggaagggaggaagggagctcacttcggcagcacatatactaaaattggaacgatacggggattagcatggccactgtgcaaggatgacacaaaaattcgtgaaaccttctgtatttttggtaaagaaaaaaaaacctaaaagaaaagtcaaaccctcagaaaaagaaaatacagtgcaggttgacagggatggggggaggaggaaaggggaagttcagttttgtttcagttttgtaagatttaaaaagttctaaagctctgttgcaccacagggtggatgtagttactactactgtactgtacacttaaaaatgttaagatggtaaatgttttctaccacaataaaaaaattattcttggccagatgtggtggctcacacctgtaatcccagcattttgggtggctgaggcaggcagatcacctgaggtcaggagttgaagaccagcctggccaacgtggtgaaatcccatctctactaaaaatacaaaaaattagccaggcaggttggtgcatgcctgtactcgggaggctgaggcaggagaatcgcttgaacctgggaggcggaggttgcagtgagccgagatcatgccattgcactccagcctgggcaacaagagtgaaactcttgtctcaaaacaaacaaacaaaaaattactcttaaaaagcaaataaataaaaagaagcagattttgtagtcaggcccatctgggttcaaatcctagttctgcttattcctaatgtcaggcaggtggaccccatggctttgagcctcagtttactcatctgtaacatgggcataagaatagtacctgctgggcgtggtggctcatgcctgtaatcccagcactttgggaggccgaggcgggtggatcacgaggtcaggagttcgagaccagcctggccaacatggtgaaatcccgtctctactaaaaatacaaaaaattagccaggcattttggtgcatgcctgtactcgggaggctgaggcaggagaatcgcttgaacctgggaggcggaggttgcagtgagccgagatcatgccattgcactccagcctgggcaacaagagtgaaactcttgtctcaaaacagacaaacaaaaaattactcttaaaaagcaaataaataaaaagaagcagattttgtagccaggcccatctgggtttgaatcctagttctgcttattcctaatgtcaggcaggtggaccccatggctttgagcctcagtttactcatctgtaacatgggcataagaatagtaccagctgggcgtggtggctcatgcctgtaatcccagcactttgggaggccgaggcaggcggatcacgaggtcaggagttagcgaccagcctggccaacatggtgaagccctgtctctactaaaaataccaaaattagccaagcgtggtggcgggcacctgtaatcccagctactcgggaagctgaggcaggagaatcccttgaacttgggaggcagaggttgcagtgagccgagatcgcgccattgcactccagcctgggtgacagagcgagactctgtttcaaaaaaagaaaaagaatagtatgtttcttccatggttgggacattcgagtgagacagtgcacataaaacagtgcctggtttttagtagggttcattgacttttccagaatctcccaacagaaccaggctctggactcctggtgtttactcccggctcagtgcttattcctttctgtgaagctgaccctgccagtagcttccctgtacctgccaaattctgtcctgcaaacagtgtcccatgagtcctggctgtgggaactgggcatttggcctggagcagcctcaggagtatgatgggatcttggccttggacttggctggcttgtcccagggcagagggagctgggtgcgctgtgtggccccagctgaggaatcagctaaggaatcgagggaggcaggcgaggtgcagcatgagtagctggactccagcagcgccacctcgctgggcctgtggtcttgagtgttccttagactcagtttctttaggtgtgaaatgagagtcacagcagcccagcacctggcacatagtgagtgcggggttgaaactagccaggtattagctgtggtcctggtgagtgactcagctccttcagcccggactgcaccttctcatctgctggctgagggctgagatggagacagagtgaggatgtgcaggagcttggaaacttggagctggtgtttttttcctgaaggggctcagagtcttcatctgttagtaaggattattcctgtctttccttcattgggtgttctcaagcgcctgctgtgggccaggccctgttctaggctttagggatatagcagccaaaacagagccctgcctcctgggagttacgttctaacatgggagaaaggtgatgaatgaatattaggtccagtggcaggtggtagcgggtgctcaaaagaaaacaagtggagttaagtgagtgaattgtgtggtatatgaattacttctcaataaagccacagagtgaaggagctggggtagataagtggggagctatttagatagagtcactgaggacggcttttaggaggagatctgaaataagcgggggagcagaagcacagaggtccgagcagaagcacggggcatgtctggaatgcccaaggaatggcgtgaggcgagggcctgtgtgcctggagcagagtaggggagggaagaaatcagagagggacaggccagcacctgtgagggctgagtggttgggagtggggtggggggtggggtgcggcccaacatgtgtcagcaaatctcctggaggcagagcccagcctggaccagactgcatccacacattgaaagatgaccaacatcattagccatcagggaaatgccagtcagaaccacaagataccacttcacccacactaggctggctgacatggaaaggacagactataacaagtagtaggccaggcatagtggctcatgcctgtaatcccagcactttgggaggccaaggcaggcggatcacctgaggtcgagagttcaagaccagccagaccaacatggagaaaccccatctctactaaaaatacaaaattagctgggcatggtggcgcatgcctgtaatcccagctactcaggaggctgaggcaggagaatcgcttgaacctgggaggtggaggttgcagtgagctgatatcgcaccattgcactccagttgaagatcctgatttctctatattcttgtcactacttgtgttttgttttgttttgttttgttttttgtttttggagatggagtctcgctcttgtcccccaggctggagtgcactggtgggatctctgcttattgcaacctacctccacctcctgggttcaagcgattctcttgcctcagcctcccaaatagctgggattacaggcgcctgccaccatggctggctaatttttttgtatttttagtagagacagggtttcaccatgttggccaggctggtctcgaactcctgacctcaggtgatccgcctgcctcggcctcccaaagtgctgggattaccggcgtgagccactatgcccgacccactgcttgttacagtctgtcctttccatgtcagccagcctagtgtgggtgaagtggtatcttgtggttctgattggcatttccctgatggctaatgatgttggtcatcttcccatgtgcggatgcagtctggtccaggctgaagtgtccacaccagtctctaaatgaacggcccggaggatgggaggtgaagagttaagggggctgatattttagagagcgaggtcttcgtactggctatgcagaagattgagccaccacctcgagaggaaccaatagcttatttcttcaatttctttttttttctctttttgagatggagtcttgctctgttgcccaggctagagtgcggtgacacaatctcagctcactgcaacttctgcctcccaggttcaagcgattctcctgcctcaggctcccaagtagctgggattacaggcatgtgtcaccacgcccagctaattttttgtatttttagtagagcctgggtttcgccatgttggtctggaactcctgacttcagatgacctgcctgccttggcctcccaaagtgttgagattacaggcgtgagccaccatgcctagccaattcccttatttctgaaggttagcaggttggttcacctctgaggtatggcccacttgaccttagaagtgagcttgctgcaggccgggcgcggtgactcatgcctgtaatcccagcactttgggaggctgaggcgggtggatcacgaggtaaggagatcgagaccatcctggctaacacagtgaaaccctgtctctactaaaaacacaaaaaattagtcgggcatggtggcgggcgcctgtagtcccagctactcagaaagctgaggcaggagaatggcgtgaacctgggaagcagagcttgcagtgagccgagacagcaccattgcactccagcctgggcgacagagtgaggctccatctcaaaaaaaaaaagaagtgagcttgctgctaagctcggttgtgtgtgagggggtggggtttggagctctgttgggtggtgacctcagtcctgtttacccctgcagaagaaggacccagcccagttcctgcaggtacatggccgagcttgcaaggtgcacctggattctgcagtcgccctggccgctgagagccctgttaatatgtaagactgatatggaaggcaggggagtgtctgaagtctgggagtcaaaacggacctggggtggtgtagagtgtggagcagagactgaagtatggacagacctttggggactcagaggcagggaaggtgtgacccgcatatgaaggtgatagtcacagggtgtaagaacaatgagcaggggttggggtggaggccccagagtagcagtcatggttggaggacttagaaatgggtggagccagggccagaggcccagaggaagcagagagtaggttgccagacccgagctggctcagggtgcctggggcccgcccctcaaataccctctaggacctggttcaagttccccactattgcttggttgtgagaaatggggccctggtgtccccaggggcagtcagatgactggcctgtttcaggtcccaggagcctgaatgtggattcagggaggcttgcaacagaagggactgagagctgggggttgaggtgagggtcatggcatggggaccaaagcaggctgagggccaggcttctaagcctcagctggcagggagcaggtgctttgtgtcctgggcagtatggaccctgaggttcttgctttcttgctcccctcccacttcaggatgccctggcagggggacaccaacaacatgattgaccgattcgatgtccgtgcccacctggaccacatccccgactacaccccccctctgctcaccaccatgtaagccacctcccagggggttgccaggcacagcgtcatacccaggagcccctgttcttttcccagcctacctgtcaccttcctaggagccgttcctatttggtaccgccctgagcctgagggggatgcctcatttcccttcctgctggcttggggggggatccactccttctctctgatttcaaggtctcgcccttccctaaagctccccagaacaggagtcggacgaacggaagtgtaactacgagcgctacagaggcctggtgcagaacgactttgccggcagtgagtgatctgtggggggacgtggggtgtggggtttgagcctggagcctggaagacctagataggtttgggaagaaaagttttatccacatactttctactaaagggccttgggttccggctccagctctacgatagactcactttgcctgcatctctttccccttctagatttggtataggggatgtctgccgaatgggttgttcccagcagagtcacgtccatataccatgccttctgactctgtggtccgtttttctttaaaaaatagagaaaatagcaagaatatgtttttatttttatttatttatttatttgaggcggagtttcgttcttgttgcccaggctggagtgcagtggtgtgatctcagctcactgcaacctctgcctcctgggttcaagtgattatcctgcctcagcctcctgagtagctgggattacaggtgcccgccaccacccccagttagttttttgtatttttagtagagacggggtttcgccatattggccaggctggtctcgaactcttgacctcaggtgatctgctcaccttggcctcccaaagtgctggattacaggtgtgagccaccacgcccagccaagaatacgtttttaaaagcatttagaaagatggggtctcactgtgttgtccaggctggtctgaactcctgggctcaagtgatcctcctgccttggcctcccaaattgctgggattatagacatgaaacactatgcccagccaggaacagattttttacctctgtgtattttactctgcccgcacagatcagattgtgagctctaaaaaggaaatttctccttgatttaaatgaatatttgccagcatttgacaatttgccaagtgttcatgtatgtccaggaattttctcccagcccagccttatcaccattgtcattttccaaatgaggaaacagaggctcagggaaacttctcgctgctctgggcttgcccagggaggtttggatcccaacagacttgggcttttttgtctgtattatcattacatctgcacaaccacctagcaaggtaggggtgacaccccgttttggggttttttgttttttttgagattgagtcttactctgttgcccaggctggcatgcagtggcgcaatctcagctcactgcaacctccacctcctgggttcaagtgattctcctgcctcagcctcccaagtagctgggattaccggcgcatgccaccatgcccggctaagttttgtagttttagtagagacggggatttcaccatcttggccaggctggtcttgaactcctgacctcgtgatccacccgcctcggcctcccaaagtgctgggattacaggcgtgagccaccgcgcctggccatcaccccatgttacagacaagaatgtcgagggggaacaccctgtccaaggagctgggattctccacgtgtccttaaccactgctccctgttgatggaaagctcctaactcacctaccaagaaggacttgagattccctttcttgggattccctgtggagttaagggaaggatggagttctctgctgggtttgtcccttaccacctggcaggtctcggcttcctcctcgagaagggtggtggtgttgattttgttgcgtggggtggttgtaagagttgagtgagatgatgtgtataaaaccccagcaccgagcctggcacagtcagccctccatgtgggtttgctagtccagtatttgtttatttctaagatagatgcttttttgattttctaaaatcagaggctgccaaaattctagtgatcactgaggccttagaatcagggacatgtgttataattgatactgtttttgccatcattccaggccacatggcttcctggtggtagagccagggttccccttagtttcgcctcactctgcatttattcattcacttccacaaacagtcattgaacacctgcggtgtggcaatggtaggggagagggcagcagctccataatcaatgtcagtgatgccaattgcaaaccaaggtgatgtgacagacagtgtgccattctctgagaaaaataggacagaagtcctggatagaagctccctgggaggcacggataggccacaggattccaggccgagagcagcctgtgcaaagccctgtgtcagccaggactgtgagcacactggaggggcagagagaaggcccgtgtggctggagcagggagagcgagggcgcttgtgcaagacagggtcagcagggcctctcttgggctttggagacaacaagtagaaattggggtatctgctagaacaaggaagggccgtgctacatccccttctggcctgccagcctgcccacctcttgttccagatagaaaagctgaggccagccgggcacggtggctcatgcatataatctcagcactttgggaggttgaggcggtggatcacctgaggtcgggagttcgagaccagcctgaccaatatggagaaaccctgtctgtactaaaagtacaaaattagccaggcacggtggcgcctgcctgtaatcccagctactggggaggctgaggcaggagaatcgcttgaacctgggaggcggaggttgcggtgagccaagatcgcgccattgcactccagcctgtgcaacaagagtgaaactctgtcttaaaaaaataagaaaagaaaaactgaggcctagggagggaaggaaggaaggggacttacaacccactgtcccacagcgagtcagggacacgtgtctcactgcagggaagatcaggaaggctctggtacattgttgagtcccccaggctgggtgttgggggtgcaggagagcccaggtcatcccagcccacacctaacttaaaatgagccacagagaggcatgcagtggagtgacctgtgcagtcagaatggcgtgtggcactcaggagcaggttatggttctgaagggtccagccagaggcctccagaaacagtgagaatggtggtagagtgcccaagtaccaggccaggcactcactctgcccgtggtcccattttacggaaaaggaaactgaggcacagatgtgttaagtcccttgaccaaggtcgtgtgtccaaggctctgctgcagttgcttgtgtcccaccagacatagtttgattatctggaagtggtgactgccccccaaggtgcactggggttgcacctgtcttcctgccccaccgcacccttgtgttcccccactgaattcctagtgtccccaacccactctgacctggggtctcttgtttgctgcagtctcagaggagcagtgcctgtaccagatctacattgatgagttgtacggaggcctccagagacccagcgaagatgagaagaagaagtgagtcggggtctggggtgcagggggttgaggaggcaggagggctgggagccccagccaggcatggcctcttccatcctgtccaccagggtctccccgaaaccaaggatggtgttcagcacacagtcagtgctcaattaataactgtgtagaggaagaagccctgtcagggggccccggcttgccgagggctctgcgttacattttcagcttgggaagtggtgggaggtgcaggccctgtggtgagacagccctgggtttgagtcctggctgtgaggccctgagtgggaattgtctgagccttgctgtgcttccctgtaaaatggggctggcaggaggccctactgcctggagttgggaggcatgcaggagatggggcttgtgaagtacctattccagcacctgccatgtagtgagcttgcagtcagccctagctgatgtcactctggagagaggcttcttaaagccgcgtccctcaaggagtagctggggagacccgggccttatcctggagcagctgcctctgaggagcagtggccgagcagtctcacttctctcttctccacctcagtctgatgagtgcaggcctcccgccctcacacacgctattccctctgcagggcttagctctcctccaggccagctgctgttgccctggtgcacggtagcctggagccctggctcggggctgggcagctccctcagtgacaccttccctcctgctacccctgactgcttgccgccttcctccactgggaggggtcccatgggactgtactgggagcttcttggagacttcagccctcgtccacggccccagcctcaggatcctgctcaggccctgctctgttcagggcaaagctggggcacctggctgctcaggaggactctgggctgtgcccttgtgggactcatggtctaggcgggagacagaccttccccaacagagatgacccaacaaaggcagggctggggagctcaggacagtgctgacccaccctagggtaccagtcaaggacttcttggcaggtggggccctagagctcagatgtggaggaagagggaggagctgggtgtgggcaggagcagagggtcctaggctgagggagagcctgaggggagggggccgtggcactcgagactggtgtgtggggctagcctggggccctcatctccactgggcacggccctggcttaccagctcccctttctcaggctggcagagaagaaggcttccatcggttatacctacgaggacagcacggtggccaaggtagagaaggcggcagaaaagccagaggaggaggagtcagcggccgaggaggagagcaactcggacgaagatgaggtcatccccgacatcggtggggtcccctctctgccctccccacctgcagtccctgggcatcgtttctgtgtctcgtccctcaccctctgtggggcaccccgtgcttacgaaccgtgtctctctccctaccccgccccagggcacaccagcctcctgctgcccctgtctcactcctgtcctcctccgttccggccttcctctgcctcactcatctctcatttctagggtgctatttctatgatcttttcccctcctaggtgttggctccattctcctccacttgggccggcctctctctgcctttgcccctctctcctgctctcttccctcctctggaaaacaagtgttcatcctcttacagagtcagcccccatccgccaggcatctgttcaccctcctctctgccattcacctcccctctggattcccactgatcaaaccacccccaagtctctctgtttttctcatcctggttcttactccagcaactggctctttttatttatttatttatttatttttgagatggagtcttgctctgttaccgggctggagtgcagtggcatgatcttggctcactgcaacctccacctcctgggttcaagtgattctcctgcctcagcttcccaagtagctgagactaaaggcacacgccaccacgcccagctaatttttgtacttttagtagagacgggggtttcaccatattggtcaggctggtcttgaactcctgacctcgtgatccacttgcctcggcctcccaaagtgctgggattacagacgtgagccaccgcgctcagcccagtagctggctctttattcacactctgtggagccacacattgacctccgcccagccctccttcctctggcttatcacacgccctgcttccaaacacctgtgacccacaccctgcctgccacccaccgtgatctccagccgccatctttccgcccctgttcagtcctccctctcacgtcaaccccaccacacgcctcactcatccattcctccctccctccatccacccatccctccttccttccttgcctccattccattcatccatccatccatccctgcatcccttcatccatccctgcacccatccgtccatctctcccttctctttccctccctccgttcatctgccccttcaagccctgtccccgagctgcctctgtccactgtgtgttgtgctcacctctggcaagcccagtgccagcctagggcatgccaagatgagccagacttgatgccatcccttcctgaagaatccctcagtctggcgggcgccccatcatccccgcctcctggagcactgccccttctcccctgtcctctcgctcggccgtggctcctgacagcctttctcttggtgcagacgtggaggtggacgtggatgaattgaaccaggagcaggtggcagatctcaacaaacaggccacgacttatggcatggccgacggtgacttcgtcaggtgaggcctgcctgctgacacccctacccattctgtgggccccaccctggcatctcactattactcccggtattgacagccatcctgtttgtgagcatttgtgtgcctggccctgggcccaggactttacacatgcaggtccctgagcctatggtggtcgtggccccacttcatctgtgcagaaacaggctgcacccaagtcacccagcctgccctacttagtgcgacctggggcgaatctgactcttcgaagctctggggattcctaggctgggggacagcgccctctagtggagaggcttcattccctggttatttatcctggcagttgctggttgtacctctaccctgagccacaccccctgctgagctcacaagaccacacagaatggtcccagctcactgggcagtgaaccagaaacggagcctgagcatggcaccctctgcccagagccctttgtggctcccacctccctcaggaacatccagtgtcctcaccatggccgaaaggtcttacccatctggtcctctcaaccgccaccatcccccgctgcccagcctgcacagtctccttgctcctcaagtgcagaggcctgggccagcccctgggccactctgtctgctgttcgctttggacgtctgcagcttgctcccccaggtttttctctagataccctgttttgtgtggcttccctgagctccctcttgaaaactgcagcttcctctgcctttgctctaccatctaatggaccacacattttattcccttgctcattatcttctcccctagaatgtaagcccgtgcaggtgaggatttctgtttttttttttcagtgctcagttcttgatacctaagatagcacctggcacacagagggtgcttgataagtggcattgaatgaaagatacctcaggctggcgtggggtgactcaggtccctcactttctctgatgactcagtctgtgtcctccttaccctgtggcctgccccatcctccaccctaattctcacccacctctataggatgctccggaaagacaaggaggaggcagaggccatcaagcatgccaaggctcttgaggaggagaaggccatgtactcggtgaggtctgggctggagtggaaggggacaggggtgtgtcacagggagggcaccccctcaccaacctggcacccaccctactccagggacgccgctctcgacgccagcggagagagtttcgggagaagcggctgaggggtcgcaagatcagcccacccaggtagggcttctccctgaacccccaccctgctggcatctgggggaggagagcaggggcttagggcctgagaaagctctttggaggcaggcatttgacttgagaaaggagtctttctagtggggcgatgcatggccatcgtgaaggtttagaggtaggaacggccttgagggccatgtggactcctttccttgccagcccctcccctcaccctactggactgggggcccttgccagactcccaggagcccatgcacaggcggcataaggctctcaccaaggcggcagagagggcacaggctttgccctggactctcacccagttctgctgcttggcttcttcctgtgtcggagtttggacaagtgacttcccgaactctctgagcttcaattttttcctttggaaaacaaggcattatcacctacctggagagagggctgggcagtccccacagggaggtcttgggacaggtttggatgaggcaggctggcttggagaggaaagcccagcctgggtcaggaggccttgaggagaggccctgtgcaaacccatgcctctttttgccacatctcttaaaggagagtgactgagagttcctgtaaggcttaaacaacttgtaggttcagcggttggtatcggaaacattccttaaagaatagcaccaatcgtcattgctgtcagcggtggcacagaggcacacagagggtagtgcaggaacgcccaggctgggtggccatagggcctgggtttggatcccagtttcctcctttatgagctacgtaatgctggacaagtgacttcacctctctgggcctcagtttcctcagctgtgatagtctctcttttttttttcttcccccagagacagggtcttattctgtcacccaggctggagtgcagtggtgtaatcacgactcactgcagcctcaaattcctaggcttaggcgatcctcctacctcagtctccttagtagctgagattactggtatgcgtcaccacgcccagctaattaaaataaaaaatacttagtagagatggggttttgcggtgttgcccaggctggtctcaaactcctgggttcaagtgatcctcccacctcagcctcccagagtgctgggattacaggcgtgagccaccgcacccagcctattttaatcttatcatcatcatcatcatcatcatcattagtaagcccggacccagtgagagccagagacaaggattgggaggagggatgctttcattctagggtcaggaggccaagcagaaccagagctgctgaagtccaagttcctcagagtcatgatgggtctaggacattgtagggtggggcttaagttcatgctttggacagatctgaggtgggggtgggtggaggaattaaggggaggcccccaacctggtcagcagccccctcactgtgccaggtacctagctttgggtcctcaggttggcgggcttatcccaaattcatgactgctgagatcttaagccctaatttgtcccaccccattcttttctctgtagctatgcccgccgagacagccccacctatgacccctataagcggtaagttgctctggaggaccagggaatagcagacagggagcctcctgatggggacaggggtgctgaggaggggatgggaggttcaccctgctaggccaccccaagatcacagactgcatgatatgttctgggtctgaatcatttttgtgttttccagatcactgtcttgttttcccagttttaaataaaattttttttttgagacggagtctcgctatgtcgcccaggctggagtgcagtggcacgatcttggctcactacaagctccgcctcccaggttcacgccattctcctgcctcagcctcctgagtagctgggactacaggtgcccgccaccaggcctggctaattttttgtatttttagtagagtttagtagggtttcaccgtgttagccaggatggtctcaatctcctgacctcgtgatccacccacctcagcctcccaaagtgctgggattacaggcgtgagccaccacgcccggccaataaaattttctttatctttgaagcttctttattttatttttctgatttaaatacagtgcagccttgtggtaaaaatgaccaaatatggcaaaacagtgtgactgagaaatcaagtcactttaatctcaatttccagaagtggccagtgggaaataacgggcactcagtagcaccgctgggcacaggtcgttgtctcgtggatgaaagagtggttggagaagggattttgtgagggaccaagctcagtctgatcccagtccccctcatccaagctccatagctctctgaagcccagttccctcttcggaatgggggtgggaatgggatcttcctcatggggctgtgggtcgaggttagatgagataaggtgttgaatggcttctggggaaataaaaggtgtaggttagtgctccatacatgggagtgtcaggaatatcagatactttctttttatttttaaaattttatatattaaaaaacacgtttgttttttttttctttaaaatattgagatggggctcaccatgttgaccaggctggttttgaagttctggcctcaagcagtcctcccacctgggccttccaaagtgctgggattacaggcatgagccatcacacctggccactttgtttttattttactaaaatagaattgcaccacactcagtgttttagaacttgctttttcctcccagattatccatgtatcttttgagtaaaacttttctgtgttttgtacagagatctgcttatctttttttttttttttttttttttttttgagacggagtctcactctgttgcccaagctggtgtgcagtggcgtgacctggactcactgcaacctctgcctcccaggttcaagcagttctcgtgccctcagcctcctgagtagctggaattacaggtgcgcgccaccatgctcggcaaattttttttgtattttttgtagagacagggttttgccttgttggccaggctggtctcaaactcctggtctcaagtgatcggcctgcctcggcctcccacagtgctgggattacaggtgtgagccaccgcgcccggcctgctcatccatttttcatagccacataaaatcagagcagttgtgtgtcattgtccttcctggttatttagcgaaggctgcatggttgtgagtcaagtccttgtccagagctgggtctccactgccctccaggctccatccacccgcctggtttcccgggtcgctgtggcccgcgctggcgctgctgttgatctgctgtgtgtgctgttcccgaagaggctccgggagcctgagctagtgagcctcctcctccctacccgcaggtcaccctcggagtccagctcagagtcccgctcccgctcccgctccccgaccccgggccgcgaggagaagatcacgttcatcaccagttttgggggcagcgatgaggaggcagccgcagccgctgctgccgcagcagcatcaggagtcaccacagggaagccccccgcacctccccagcctggcggccccgccccgggacgtaatgccagcgcccggtcggtaacgctcacgccgcccgccctacgccccggtcaccatggggggtacccggggcagaggggggccgcggctcaggcctgcgctgaccggccctccgtgccccgcctgcagccgccgctcctcctcctcctcctcctcctcttctgcctcgaggacctccagctcccgctccagctctcgctccagctcccgctctcgccgtggtgggggctactaccgttccggccgccacgcccgctcccggtcccgctcctggtcccgctcccgctcccgctcccggcgctattcccggtcccgtagccgtggccggcggcactcaggtgggggctcccgagacggacaccggtactcccgctcgcccgcccggcgtggtggttacgggccccggcgcagaagcaggtgtgtgtggctgggcgtggaggtgggaggggctgggggggcgcggtctccgatcctggggagaaggtgctcagagggaggaaacctggccgtccagctcagagaacaccccatctaaggggacaggcacaggccactgctcttccgcaggaagcccttggttggaaagggcaaggcatgggtgtttgcgtgcgcgttctggtggcagtggaggtggatcccagccgctgttttccacgacagggtgtggagaggagactgtgcatctctctctcctcaggagactgtttttgctgtcaggggttccaggtggaggggagtagaaagcgcatggacgctccagggttttctgtagcttgaagggacgggtccgggccttgagggctgggaaaccccttgcggagggggaggggcgcgttcctgtgtggccaggagcggatggggaagcgaagcgggtggaaaaaatcaagacagctctttggcctggcgtggtggctcacacctgtaatcccagcactttgggaggccgaggcaggcggatctcctgagctcaggagttcgagaccaccctgggcaacatggtgaaaccccgtctctactgaaaaaaaaattagctgggtgtggtggcacacgcctgtagtcccagctacttgagaggctgaggcaggagaatcgcttgaaaccgggaagcagaggttgcaatgagctgaaatcgtgccaccgcactctagcctggtgacagagtgagattccgtctcaaaaaaaaaaaaaaaaaaaaaaattagctgggcgtggtggcacgcgcatgtagtcccagctatgcaggaggctgaggcacgagaatcgtttcagccccgcaggcggaggttgcagtgagccgagattgtgccactgcaccccagcttgggctacagagtgagactgcgtctcaagaaaaaaaaaaaaaaaagacatttcattttggagacgacatggtgagaggctagctctagggatggtttagaaaataaagtcacctggggactggtccacccccttccggtccccttgcctgttggggtcagggctgccctgggaagggcagcgacgctgggttggtaggagcatagactgcagggcacctgcctgagtgtagagtccctgggcctctaattctgtaaaatcgcggtaatagcatccgcttctctgagctgttagaggtgtaacaggtaaacccatgtaaggtgcttaggacagggctggtgctggctaagtgccgttaatatcgtcagcatcattacctgcgttattgtagcactgatcgccatgtcagctgccttcagggtctggcaggtaaagtagaggggccaggtagagatcctgctgacctggcaagcacatgttccctccagtcggggcgttgaccgctcagcagcaggtctagtgtcacccagtctttctagttctcaggagaagttgagggtctggatttttagaggatagctcttgtttcctttacttttttttttgagacagagtctcactgtgtcactcaggctggagtgcagtggcacaatctcggctcactgcacctcctcctcctgggttcaagtgattctcccgccgcagcctcccaagtagctgggattacaggcatgcgccaccacacctggctaatttttgtatttctagtagagacggggtttcactgtgttggccaggctggtcttgaactcctgacctcatgatccacccacctttgcctcccaaagtgctgggattacaggcgtgagccaccgcgcctggcccttgttttcttaataatgacaacaaatttttattttataaaaacgcaattcaaaaattagccgggtgtggttgtgcacatctgtaatcccagctattcaggaggctgaggcaggagaattgcttgaacccaggaggcagaggttgcagtgagcccagctattgcaccactgcactccagcctgggcgacagagagagactgtctcaaaaaaaaaaaaaaaaaaaaaaaaaagagcccaagcagagtcagcgtgtggcccagaattggcttccaggtcatatattccttgtagcttacccagagcaatgacaggagaaaggcttgggggacaggtgggacctgggcacatcttgcatgccagcctgagagtgggcagtgggtggagagtcccaccagtgtcctgagcagggagaggatggggttccgcatccccagactggaacttgtgggtctgtgctgagactggtggaggacaaggggtggtccccactattgtcgagaccctggacacaagcaggatgaggtggtgggtgagggtgtagatgaggtcaccgtggaacactgttgtgcctgagctggacacggctcataaagggggagccagccatccctcccagagctcacctcccgggaagttagcaagcgggtgtctagtgagggagaggtgacgtgggccaggcagggctcatgatggcaggactgcccttaggctgagtgtatctagagcgccatctctgtagccggagggaggccggaatgccgctctgggacattttggagggagagtagcaggagaggagagtcgagcctgtcaccctgggccttgcaggaaggaggactgtggatccggacccagggtggggtgcggttggggtccctggagcctcacagtcctcctcccgccctgctgcatccccaggagccgctcccactcaggggaccgctacaggcggggcggccggggcctcaggcaccacagcagtagccgcagccgcagcagctggtccctcagcccgtcccgcagtcgcagcctgactcgcagccgcagccatagccccagccccagccagagccgcagccgcagccgcagccgcagccagagcccctcgccatcacccgcaagagagaagctgaccaggccggccgcgtcccctgctgtgggcgagaagctgaaaaagtgagcggggcgggtctggaggaagagggctgccaatctcgggtggggagggtgaacatcactgttttctttttgaggggaacttagccctaccctgggaggtctggggggtggtgtatggccctggcctgggagggtggatttcagggggacacagccctggcctggggggtctgaggaggacacaccaaatcctggaggatctgcacaattagaaccttgtcctgggtgagggtcagagggggacaggtccctgtcttacaggttctgtggggtctgagagggacatggttgcaccctggggcatctgaggcccatgccttggctacctggtctgagggcagtgctgaggctggggtcagaggtggcagctgccctttccccctcccaaccatgtcctctggccctgcccccacccaggaccgaacctgccgctggtaaagagacaggagctgccaaagtcagtaagaatttggaactcgcccgtctaattcccgtcagcagcagtgcccaagagctgggcccggtgggcctgcaggggggcccgggtgggctgggagatccagccccagggacagggaggggaggggaagggtctgcccctgtgagaaccatgtccctctcccctcctcactgtacactggggctccacctgtcactgaacctctgggagcctcagggctgtccacagcctgcccctcctccccacgtcgttctcccccccccaccccccccccgcacaaagccccaggcttttggctgaggtgggttgtgggagctctgggacacccaccccctctcccgcctcttctcccccctccccagcccaagctgacgcctcaggagaagctgaaactgaggatgcagaaggcgctgaacaggcagtgtatgttctgccctgtccctccagggtttcacagctcttctttcccttggcagtgggagcaaggagactcagcaccactttgggaggcctggcccttccctagagaggccacgcaggcacggaggtgctctggggaggaatgggtttgcatcagctccgctgccgctatgctggggcctctgcagtcaggttgacctgtctgagctcagcttcctcattttagagagtggggctcttagcgggcacggtggctcacacctgtaatcccagcactttgggaggccgaggtgggcggatcacgaggtcaggagatcgagaccattaacacggtgaaaccccgtctctctaaaactacaaaaaattagccaggcatgttggtgggcgcctgtagtcccagctactcaggaggctgaggcaggagatggcgcgaacccggggggcggagcctgcagtgagccaagatcacgccactgcactccagcctgggcgacagagcgagactctgtctcaaaaaaaaaaaaaaagaaaaaagagagtggggctcttaagggaacccctcagccaccctgttctttctctctacagtcaaggcggataagaaggcggcacaagaaaagatgatccagcaggagcatgagcggcaggtgaagtgggaaagggagggctggggtgacgggtgggtgctggcctggccacgtcctcatagccctgtctgctgcaggagcgggaagacgagcttcgagccatggcccgcaagatccgcatgaagtaagaccttgcccctccctgtcccatggccacacctcctggcctgcctggccttcccaccatgggctgctggctcaagccctgcccagctccctgtgggtggatgaaaggcagagatccctgcctggccctcggggctgtgcccagctgcctctcttgctcctctccctgaatttcctcccaccatttcgacctgcctcccgccaccgcgacctcctcccagctcttccagcctccaagtgccagtcacctttgctgtttttttggcctggcaagctgttcctgataccccttccccactcacccaccgccatgggtctttctcctgtcccagcctcagtttgcttatctcctaaatggagatacagtcactgtcccacctcacaggctgttgggaggatttgacaagatcaaggccaggcacggaggaggcacccagtagacgtagccattgggttgccaagcctggccactgtgacggagaccatttcaacactcactgtgtgcaggtgccccagtgcggcaggaaatgatgggactatcctgcctccctctgttccccaggctttcctaggaaggggctgggattccagtcagccccgccagctggggtccctctgaacctggggctccctttccaagcggggattggtggcagtaccggcccccttggtttactgtcttcctcggagtagggtgttggaagcacctgccctccctgagttcagtgtgtccagtgttcccggccagatgctcatgccatgccttcgcagggagcgggaacgccgagagaaggagagagaagagtgggaacgccagtacagccggcagagccgctcaccctccccccgatacagtgagtgtccccaccaggctgcagggctctggggctttaaagaaaagtgtcaagcagggttaccaaaaaaaccatagtacagccgggcgcggtggctcacgcctgtaatcccagcactttgggaggctgaggtgggtggatcaatcacctgaggtcaggagttcgagaccagcctgaccaacatggtgacacacatacgtacacacacacacacacagattgctttagtcacaaggtgattgcagcaattagaagtgctcattccggcatgggctggtgaggggcacagatggcagccactggactctctggaaatgtcccctcatttggagacaacccctgaagttcagttttgaggacctcaccccaggtcaaggaagaggccctggccctggatgtttgctcgctcttcacctgttgttttctttccaggtcgagaatacagctcttctcgaaggtaaggaagcccatgaccctccactttcttggaagtaacacttgtcctttgatgggaggtcctggctgtcattcctccagcctcaccctgtacccacctccagttggaggggctggtctcatcccttggggaacatccttccctccacagacaagtgccccgatcactgaagcatccacggccccaggtgtgttgatgtgtgtatgccccatcctcacggcccctccctttctctttccaggcgctcaaggtcccgatcccgaagcccccattaccgacattaggcagaagagtggggggtggggaggacaagggggtgggtaaggggctcaagctgtgatgctgctggttttatctctagtgaaataaagtcaaaagttatttaattcccgtcacctgtctcagtgtcatctgtgtggttggtgcagggctctcccaccccagggcccatgggccagcagagccagctgggagggcgcttgggtttacaggccagatgccagtgctgcctgtgtgggacatcttgcccccatctgatggctaagtggcaggcccctgttcatcagaacctgccatggctcagtgaggcctgctcaggaggccagggcacagtcccaagggagagggcccagacctgcccgcagatgtggacatagggtgtcggcccagcatgtcccacatgggcccctttgcccagggcctctggcgacaggtccgggcctctccccgccctcgcctcagcccctgccctggcctcgcccgcactaggaactgggagcgcagctttctgtgccagtcctgctgcgccccaggcactgggggctggccgttccctcaccccctcactccaaaccggtctgtccagccgtccaccccacggaggggaagcctcctgccccacctcatgcaccccaagaaagccagagtccagacgggtgtaaataaaagggaaaatttacttggagaaggcgggcaaaaacgaggaggtcaatgggtgttggcagcggtaccagggacagtgaggggggctttcctgggctcaggcctcgccggccgcctcagggtgcttctgccgcaggtgtttgtccagggtggctcgcaggccgaagggcacatggcagtgggggcactcgaagcgggtgctgccaggcgtcatgccgtgcatgcggcggtggcggttgagcttactgctctgggcgcaggcgtagttgcagaactcacaggtgtaggggcgctccccggtgtgtgagcgccggtgcaccgtcaggttgctgctgttggtaaaatgcttcccgcagaactcacagctgcccccgggcccgcggctcttgccccctgacttgggcatctttttgggtgatgccttctggctgtttgcagggtcagttctttgttccgtggtgatggctccccaagtgtctccaccagggccggcttgagccccactgccaggagccccgggttcctggacacctgctgtggcggcggctccagccccctcaccaccgctgcatggaagggtgctggtgggggcagcagcatggacagccggctccggaggggctgcagaggcctgctcctggctggtgtcggccatgagggggctctggggcggcacctgccggtgggtcttcttgtggcggttgagcttgctgctctgggcgcaggcgtagggacactggtcgcaagcatagggccgctcgcctgtgtgtgagcgcatgtgcactttgaggttgctgaaggagctgagggtcttcttgcacacaggacaggtggggctccgccgggtgaggccgctgccacttgcacgggggctcttggcctcagctgctggccccaccactgccgacacggctgcagccacctcggccaggcccaggagcggggcctccggggcctctgattctgtctggtagatggacagtccgtggtcccactgggcgtgacgcagcagcttccaggccactgtgaactgtttgccacagcgcaggcagctcaaggccttcagctcctctcgttctggtaagaaaaagaggcagagtgttagtgcggacagctgccagctggacaccttctgtgggataggcactcctgcaggggcaaaggacttggcagtaacaagacacacacaccctggaaggaccaggaagctgacgctcagaggaggggtggacacgaaaaatctgtggagtgggtgctaagtacctgaaaacatttttttttagacagtctcactgtcgcccaggctggggtgcagtggcacgatctcagctcactgcaacctccacctcctggattcaagctattctcatgcctcagcctctagagtagctgggattacaggcgcccgccaccatgcctggctaattagtagagatgggggtttcaccgtgttggccaggctggtctcgaactcttggcctcaagtgatccacccacctcggcctcccaaagtgctgggattataggcatgagccactgtgctgggccatgtgtttgaaaatcttttaaaaagttatgttaactcagtaagcgcttcctacatgctaggtgctgagccatggctcatagcccggctttccctcaggacaggaaaataagatctccattttccagacaggagaactgaggcacagagaggcatttccccagggttgcacagcttggaaggggtgaagctgggatttcaatccagactactgggggagggggagagggcagaacagaggcttgcttgcttttttttttttgctttaaatttttaatttagtattttttaaagagatggggtcctgctatgttgcccaggctatttttttttttttttgagacggagccttgctctgtcgcccaggctgcagtgcagtggcgcgatctcggctcactgcaagctctgcctccggggttcacgccattctcctgcctcagccaccacgccacagggtttcaccgtgttagccaggatggtcgcgatctcctgacctcatgatctgcccgcctcagcctcccaaagtgctgggattacaggtttgagccaccgcacccggccgcccaggctattctttaacttaatggcctcaagtaatccttccgcctcagcccctcaaagtgctgggattataggcgtgagccaccatacctggctgggagcagaggcttttgaataagatttttggtttaggccgggcacggtggctcacacctgtcatcccagcactttgggaggctgaggcgggttgatctcttgaggtcagggatttgagaccagcctggccaacatgatgaaaccctgtctctagtaaaaataaaaaatagccgggtgtggtggtgcgcgcctgtaatcccggccacttgggaggttaaggcaggagaatcgcttgaacccaggaggcggaggttgcagtgagccgagatcccaccactgcactccagcctgggtgacaaaagcgagactctgtttcaaaaaaaaaaattttttttggtttaataaaaataatttttaaagtaattgagatatctgggcatggtggctcatgcctgtaatcccagcacttcaggaggccaaggcaggtggaccacctgaggtcaggagtttgagacaccagcctggtcaacatggtgaaaccctgtctctaccaaaaatacaaaaattagctggccatggtggtgcacgcctgtagtcccagctacttggagggctgaggcaggagaatcacttgaacctgggaggcggaggttgcagtgagctgagattgcaccacagcactccagcctgggtgacagagtaagactccacctcaaaataatggggtagctacagagaaagcttagcggccacctagtaaagaggtggtagtgacctgggtcccccaccctctgcatggatctcaaattgagcccccaaacctgaatttggatttctatctggaccttcggggtactctcagtggacacttcctaggtgaactagcctttccatttttcaaattctagagtcttggatgggacaacctttgtgatacaaccagtcctgggtcaagagcacaggcctgcattcaaattcagacttctctgctccctaattgtgtgaccttgggcaagacatagtcctctgtgtgcctcagttgctagaattcagggaccctagagatcccctccctttcaagggtggttgtgacctcgcttggggaatggttgagagctttggtccacataagcgctcaaacagcagagcctgtgaaaccaaggtgcccatgattctccaagccctgtagtgttttgttccagcgattccatcacagcccctcgctcgctcctccaggccactctccatgctccagctctaaagctgattcaatcagtcacaagcccctcctctttcccaccaccagaccctccctggcccaaccctaaataattccacttctcaaaagtctcagaagggcaagggccagggggctggaaactaggtttggattaagccctgcagccaacactgaccaaaagctcaccgagggtcaagccccatgtgaaggcttttaattccctcccaagagaaggaacccgggtgtccagcacccgggagctcgctcaaaccaggggattcccagcacgcggggctgggagattccatcaccgagggaagccagaagccccttccttggctctgaacactcagctgtactagcacctcaatcagaattgacagagagagacaggagggggtggcaacctccccattccagctggcctccactccccctccccccggccgctgccctccctagaggtcccctcctactgccaccctggtccagccacctggccagttatttctggccaaggggaaggagaagtgaaaccaggttggggtgtgtgttggggggggcaaaatcccgggctagtcttctggggctggccacaccctgtaggcggccctccttccctgcccagtccccccccgccccccctccaccgccaccactggtccctgccctaggacgggcaggccctggccacgcctaggctgcacccgatggggagcgagaaaggggaagtagtgctcagtgccctgccgtccagcccagcccctttccagcaggaagcccagccctcgaacttgagagggggactgcacccggctttactcacctgagccctggccgcggctggggcctctgaagagctgacagcccagcttcttgtggtccatgaaggcagtgatggcctccaacgggaaggtctgcaggcagcggccgcaggtcaacagatctgggtgtttgtcggtccagggctggcggtctgcagggaggaagcgggtggtgagcgtggggtggggccaggatgggggctgagggtgctgaaggagaggggaaaccgaaggtcagaagggggcctgaggggcaggacggggcgaaggagataaggcagggcgaggggcccatgcccaaagggaagggtcccacccgagggtcaaaggtaagggaggctgggcccagggcccggggtgctcaccgggatagttcggggtcaacggcgtccacagggtccacgggttccgcgggccgagggcgaggagggcggccccggcgggcatggggccaggggagtggtggggttcgccgccgaaccgccccgccgaggacacctccttcggggagaagggccccagccttggggcctgttggggctgcgcgtctggctcgggcttgagttcgatgacgaggtcctgcatttccatctcgtcgtctgggttggcggcgggcgcgggctctactcggcggggcgcgctgccggccttgcggcgggacatgagtcgcgggccgggcgagcgagcgggcgggcaggcaggcaggcgggcgggcggaggacgcacgagcggaggacgcgcggaccgtgcgcgctcaggtgagtgactgcggcgacccgccgcgaactcttacacgtgctggccgggcccgtggctccgcctaccagggcggggctcatgggaggggaccgagccgccctgctggggccctgacggcggcctaactcaatctaggcagtgtcccgtgcgtttggcttagtgaccaaatttaatcacaccgagttcccacaaggcattgaaacagctatccctgatcccgttttagggcgggtgaaactgagacacggcatgcccacacgcacccccaagcgagaaaaatagtcggtcacgtttcttattaggtgcctgatagtaatctgggctatttcattaaatgcattacaataaaaattcattttgcaagcattcactgagtgcctcctgtgcgccaggctctgtttgaagccctgagaatacaggagggaataaacagaagataatctttgtttgcacggagttcagacggtgggggaagacactataaacataattacgtaaaatatagatggcccttcatgatgaccagtgccatggagcaaaagaaagctggaaaggcggagagggttactggggttgagggattcaattttctcccctatgatgggaaagggcatggtggagctgaggctggagggaaggaagcccagccagtgggcctgggcattgaggaattacaaggaaagggagaggcaatacgggttggggattgagttcagtgaaaatatgggggcagatccaagcaatcttttgatcgctttaaggtcttttggttttcctgagaccggagccttaggagggttttgagcagaggaggactgtaatcatacacatcgactctgttcctagaccagaagtcgccattaaaaccaaatagccaagcagctcacctgcctccactccgcctccttgaacttccctcccctaagcagttctgtctgctcactgtttgaagtggcatcgacaccctgccccaccctcaatccctgatgagtattcttttcttcctggcaccgactgcacgacagtatagaacggcttgtggactgtcctctcccccacccaatgcaagccccctgaggtcagggcaagaacctgtcctcccccagctgtcctcagcccagatgctgatttcagatgctgatctcttggagttctgcacattgttattcaggtctgggttccattgtcctcctgagagcagagggccctgaccaacagtatctaaagtagccccaccctgctgaaggccttgcaaattacactccatgacctccatctgtccccagttccctcttggatctcactttctccatctgtcaaaggaggtagggcaggttggaactagagggttatctgaggtggtttcttcttcactgccgcctcctctgatcaccctttttttttttgtaatttttaatttttcaaaaaaaattatttttaaatagagacagggactcgctttgttgccctggttggtctgaaactcttggcttgaagcgctcctcctgcttcagcatcccaaagtgctgagattacaggtgtgagacactgcactcagcctcagaccacccaattttaagttccatggcaacccagccacccactatcccattgcccttattttactctttttttttttttttttttttgagatggagtttcactcttgttgcccaggctggagtgcagtggcacgacctcagctcactgcaacctccgcctcccgggttcaagtgattctcctgcctgagcctccggagtagctgggattacagatgcccggctaatttttctatttttagtagagacagggtttcaccatgttggccaggctggtctcgaactcctgacctcaggtgatccacccgcctcagcctcccaaagtgctggaattacaggcgtgagccaccgtgcccggcctattttattctttatacatcactttgatcaaaccctgaaggatcttgtttacatatttgctcattttaccctattctgtcccttctacccccactagaacgtaggttctaggaggcaggatgggagtctgtcttgttcataaatacaacccctactcgttcatagttaagtcaacaaatatttattgcgcacctactatgtgtctgatgatattctttcaacagatatttgcagagcaccaaattgtgtacctggcactaggccttggtgatctagtggaaagcaaaggcccacaggatccctgcgtaaagaggaccccgcaaggagaaagtgaattctgactgggcctggaatagggaggttcatattccccattcaaggcctcagtttccccctttgtaaaatgggactgcagggagagctggaggacaaaatgaccgcctctgatccagcccagctactttcttagtatgcggcatctgaaaccatgatctccaggtttcctgtagaggagcgggggttcccactggaagcaaggggttaggagtgggtatgtgtagggggatggggatgcaaagaccgagctctgcccttaacccagcagggaggaagtcttcccctctctgaacctcagtttcttcctgcctaaaatgggcatcccagacgcccccaactcgcaggcaggaagatcggtcccaagtgccccgcaaagccgcgggccaggtggcgacccgggctgtgctggcttccaagcctgcgagccagcccgcgaccacgtggggcagtggcggcggcgcgggcggaacccaggctccgcggcttgcggcctgcccgggcctctgcagcgggggcgccggcggaagtggggacaccagtagccgcggacctcggtgagtacaaggtggtggggggtcgccagcaggttccctctccccggccccagctctggacgctcaccccagtgcaacgccctgagtgacggaaagaggtaggaccgcgcctgcagcgccggctggagggacgttctggtccccagacgctcctatcagggactgtttgatcccgatcgccggcagcgggaatgccccacgcgggtggggtgaggagaagggagaaggagaaaaacttcccctccggaaaataataaatggccacgataacagaagcatcggtggcagtcatcccgctttacctggagcggaatcgctcgctcagtctgagcctggaggtgggaagaaggtccagtccgaacgcccagggcggtgtggggagtggacgcctgggggccgggaggacctacttagtataagaaaaggagagcaatgggtggtcagggcggaattgaaaggaaactgaccggccccaggggagaaggggaggggagagattctgtgcttggggttctgaccctctcgggtggccccatttagctaatttgcatcaagattcagcagccgatgatgtctgtatgtgtgtgtgtgtctgtggacacgtcaacaccttggttaattaattaggtctggcggcttctctgttgacaactcagctggttccacaccctggcaattgtgaagagttggccaaatgtttgtccactgagctgatctcctctctggagcaccggggccaccaggagggaggtctgtgaaacccctgcccctgccattgacctaagtgttgggctcttgaatctaacagactagtttttcaagtcgtgggggatgggcttgggcatttttccctgaaaccttcggaaatccttgccttggagactgaaaggataaaggcctctggggccaggtcaccagggacaatggataacgcctgcctctaccctcctgggcacaccctgtgtgatctttcttaaaccagtttcttatcaggtcacaccttggctccacagtctgcctttctacatggggcacgggtgaggaccagagtttgctccctcttcctccaccctccagcttgcaccaaggaaatgatttttttttttttttttttgaaacagagtctcactctgtggcccaggctggggtgcagaggcgtgatctccgctcactgcaacctccgtctccctggttcaagggattctcctgcctcagcctcctgcgtagctgggattacagatgcgtgccaccacatccagctaattttttttgtatttttagtagagatagggtttcaccatgttagccaggctggtcttaaactcctgacatcaggtgatctgcctccctcagtctcccaaagtgctgggattacaggtgtgaaccactgcacccagcccgaggaaagatttgacctgccagcttcactggccactttacaaaaatggggattgcatcaatatgaccaaatctcccttgttttttgtttttttttttttttttcctgatggagaaaacaaggccctatactggccctcccttaatttcattttatccagggatttaacagaattctttggccactctaatcctatctaagtcatttagtaagtactcaccctagagactagggggtttctcttgaaactcaagtgttaatctaggctcaggaaagaccctgggggctggtgaggcctgactaaattggagtgacagtggtcagagaaaataaaaaatgcaagtagggcgtgttggcgtgggcctgtaatcccagcttctcggaaggctgaggtgggaggatatcttgagtccaggagttcaagattagcgtgggcaatacagcgagacctcacctcaaagtaaataaataagtaaatgtgctttttaaaaaattagaaaatgcaaggccgggcacggtggctcatgcctgtaatcccagcactttgggaggctgaagcaggcagatcaggagtttgagaccagcctggccaacgtggccaaaccgcgtctctactaaaaatacaaaattagccatgtgcagtggtgcgcgcctgtagtcctagttacttgggaggctgaggcaggagaattgcttgaacccgggaggcggaggttgcagtgagttgagatcatgccactgtactccagcctgggcgacaagagtgagactccgtcttaaaaaaaaaaaaaaaattagaaaatgcaactatcccttaattccattcacgtggtcttccctgtcaggaaaaaaaaaaaaaaccttggagtctcccttggctgctctttccctcaaattatatatcccttatcctgtccatcaccgagggctcttgacctttctttttttgtttgtttttgttgttttgagatggagtctcactctgtcatccatgctggaatgcaatggcacgatctccgctcacttcaacctccgcttcccgggttcaagcgattcttctgcctcagcctcccgagtagctgggattacaggcacgcaccaccacacccagctaacttttgtatttttagtagagagaggtttcaccatgttgaccaggctggtctcatcctgacctcaggcgatctacccacctcagccttcaaaagtgctgggattacaggcgtgacctactgcgcccagcctcgacctttcaaacatagcctaatctgaccacttctccccattcccattgtccccagcccatactagacgccatcttcttccacctggaccactacagtgacctcctcattgcgttcctagtgtctcccttcaatctcgtttattgtccatgcagcaggcagaggatcctgaggaccttaagccagattctgcccatccttcactcagaactgtccagtggcttcagtctcagagtagagacccaaattgtcatcacagcccacaaggcactctctctgtccctgcccccacctcctccacactggccttgctacgccccaaagccaccctttccatgatctttgcattttgctcttccttctgactggaatctccacatggctccattcctaatttcattcaggtctatgctcaaacgtaatcttatcatagggatctttcctgggctcccttgaaactaccctctatcccccaggctgggtcaggtgtctcctctggactccttcattccagccctactcactttgggtcatcactgcctaaggacaggtctgtgtcccctattggactgtgagcccacaaaggcggaactgggctctcagtcctagacgtgtttccaagaccgcccaatgtgggtcatgcacagagcaggcactcagatgatgtgctaacaatgctagataatgtggatgagtgaatttttttttttttgagacagggtctcatactctgtcacccaggctggagtacagtggcacagttatggctcactgcagcctccacctaccaggctcaagcgatcccctcacctcggtctccttagtagctgggactctagtcgcacactacccatgcccagctaatttttttttttttttgtagagatggggttttgctatattgctcaggctggtcttgaactcctacgctaaagcaattctccagcctcagtctcccaaggtgctgggattatagttgtgagccaccgcacctggctagaaaacttttctttggtgcataaaaatgatataaaattcaaatttcagtgtcccagtaagtaaggttttgttggagaacagccatgttcatttgtttccatattgtctatggctgctgttgtgctactgtggcagagttgagcagtgacagtaaaatacttacagagaaggttcgcagacctctgctacgtattttgccaagaagaaaaataaaataaagttaaaattgaaaatatgttgcccgctgggcgcggtagctcacgcctgtaatcccggcactttgggaagctgaactgggggtgggtcacctgagaccaggagatgtagaccagcctggccaacatggtgaaaccctgtctctactaaaatacaaaaattagccaggcatggtggcgcgcacctgtaatcccagctactcaggaggctgaggcaggagaattgcttgaacccaggaggcagaggttgcaatgagccaagattgcaccactgcactccagcctgggggatagagtgagactccatccccaaaacaattttgccaaggaggattctatttgggccacctatgggcatgtgagatcagtaagatttggcagctaattatgcagagtgggtgatgaggtttagatgcctcccagggagagctctttttcacattttcttttccaattcttcttctttttttttttttttttgtttgagacagggtctcactcttcccaggctggagtgcagtggtgcaatcacatctcactgcagcctcagcctcctccggctcactagatcttcccacctcagcctcctgagtagctgggactacaggagcgcaccctttgcccagctaatttttctatttttctggagacgagattttgctatgttgcccaagctggtctcaaattcctgggctcaagtgatccacctgcctcagcctcccaaagttctggaattacaggtgtgagccacctcgtgcccagctgcttcttgctttctgaaattaaaatttaggccgggcacggtggctcacgcctgtaatactagcactttgggaggccaaggcgggtggatcacctgaggtaaggagttcaagaccagcctggccaacatggggaaaccccgtctctactgaaaataaaaatatcagctgggcgtggtcgcgggcacctgtaatcccagctacttgggaggctgagtgacgagaatcgcttgaacccgggaggcggacgttgtagtgagccaagatcgcgccactgcactcctgcctgggcgacaagagcgagactccatctcacaaaaaaaaaaaaaaaaaaaagaaattaaaatttagtggctgggcatggtggcttagacctgtaatcccagcactttgggaggctgaggcaagaggatcacttgagcccaggttggagaccagcctgggcaatatagtgcgacttcatctctataaaataaaataaaattaattaattaaaaattttatttatttatttatttattttgagacagagtctcgctgtgttgtccaggctggagtgcagtggcatgacctcagctcactgcagcctctggctcacgggttcaagcgattcttatgcctcagcctcctgagtagttgggattacaggtgtgtgccaccatgcctggctaatttttggggcgtttgtttgtttttgagatggagtcccagtctgtcacccagactggagtgcagtggcacaatatctcagctcactgcaacctctgcctcccgggttcaagagagtctcctgcctcagcctcctgagtaggcgggattacaggagcctgccaccatgcccagcccagctaattttatttatttatttattttttgagacagagtttcactcttgttgcctaggctggagcgcaatggcgcagtctcggctcaccacaacctctgcctcctgagttcaagtgattctcctgcttcagccttccaagtagctgggattacaggcatgcaccaccactaattacagaaatgcaccatcaggctaattttgtatttttagtagaggcagggtctctccatgttggtcaggctggtctcgaactcctgacctcaggtgatccgcccacctcggcctctcaaagtgctggaattacaggcgtgagccacagtgcccggccaacacccggctaatttttgtatttcttagtacagacagggtttcaccgtgttgaccaggttggtctcaaactcctgacctcaggtgatccgcctgcctcggcctcccaaagttctgggtttacaggcgggagccactgtgcccagcctatgttcatgtcttctatagccatctttattccttcctccctctttgtgacctgtttgtctgcatcagtgtttcatttggggccatcaggagacgtttggcaattcatggagactttaaaaaaaaactgtattgagatgcaattcacattcaccaattcactgttcaccagtggtgacatttttggctgtcacaacttgaagatgggatgctactggcatctattaataggaggcagaggctaggatgctgctcaaaccctacacctatgcgttggacagcccccacaacatagcagataattatccagccccaaatgtcaatagtgtccagactgagtagccctggttcacatccttggtctatctgcagggtcctgtcttgcaaggggctcacagttcaggtgcagagacaggaagagcctaataagaaaaaggacaagttagtccaggcacagtggctcacgcctgtaatcccaccactttgggaggctgagatgggggggatcacttgcggtcaggagttcgagaccagcctgaccaacatggtgaaaccccgtctctactaaaaatacaaaaagtagctgggcatggtggtgtgtgtctgtagtcgcagcttctcgggagactgaggcacaagaatctcttttttttttttttttttttttgagacggagtctcgctctgtcgcccaggctggagtgcagtggcgtggtctcggctcactgcaagctccgcctcccgggttcacgccattctcctgcctcagcctcccgagtagctgggactacaggcgactgccaccacgcccggctaattttttgtatttttaatagagatggggtttcaccttgttagccaggatggtctcgatctcctgacctcgtgatccgcctgccttggcctcccaaagtgctggtattacaggcgtgagccaccacgcccggccacacaagaatctcttgaacctgggaggcggaggttgcagtgagccgaggtggcaccactgcactccggcctgggtgacagagtgagactctgtctccaaaaaaggaaaaaaaagaaacaggacaatttcaatcacctcccttctgtgcctggccccagggtcttgggtacccaacacttgtcactcagctcagttagtcctcactaggtttagagaggagaggaccaagccacagggagtggtgcagctgctaaaacctaggtcctcctctctcaggtctgcacccacaaggccagcatttccctatacacattcaacatcatagcatagcgcttcatatgtcccagacatgtgccaaacatggtaggttagttaggtaatttagtccccatgcccgccctgtgagttagggctctgttttacagatggggaaacagaggcacagattagtcaagccatttaccccaggtcacacagcaatactaacaataagagcagttcactattatggagaacctagaatgtgccaggccctgtctggcaggagcctgttgaatcctgataacagcataggcagcaattggggctatttttccatacaatggaagagaaaactgtctcttactgatgtcacacagctaaaccggcctgggatctccactcttcattcattttgttttttgtttgtttgtttttttcgagatgagtcttgctctgtcgcccaggctggagtgcagtggcgagatctccgcttactgcaacccctgcctccctggtgcaagcgattctcctgcctcagcctcatgagtagctgggattacaggcacgtgccaccatgcccagctaatttttgtattcttagtagagacggggtttcaccatgttgatcaggctggtcttgaactcttgatctcgtgatccacctgctttggcctcccaaagtgctgggattacaggcgtgagccaccgcgcccagccaatgtttgtttgtttttgagatagagtattgctctgttgcccaggctggagtacagtggcacaatctctgctcactgcaacctctgcctcccaggttcaagtgattctcatgcctcaggctccccaagtagctgggattacaggcacgcaccaccacgtccggctgatttttgtattttagtacagacggggttttactatgttggccaggctgctctcgaactcctgacctctagtgatcctccagcctcagcccctaaagtgctaggattataggcatgcgccgccatgcccagctcattcatgaattctcattggtctctatggcaggcagtttctgggggctggagatccagcagtgggaaaagcaaggtggccaccttgaaactcacggagggaaaggagatacaggcagatacagggaaccgaaagtgcaagagcccaagaagggattgccaggcatcgcgcctgaggatcagcgaggaggcctgtgtggctggggtggggagagcaagcgtggtacaccacgagggtgccggcaggatccagagctaagacagaagccacaagagggctccgagcagaggagggatatgatctgactcaggcattaacagggtgttggggtgcagacggcggggggtgaaggtggaagccagggacccagtgaggagttgactacagtactccaggcaggaagtgtctgtggctgcagcaggatgctggcagtggaggaggtgagaagtgttaggttgtgaataaataaatatgtgtgtgtgtgtatatatagatatataatttttttttttttttttttttgagacagagtcttgctctgtcgcccaggctggagtactgtggcacaatctcggctcactgcaacctctgcttcccaagttcaagtgactctcctgcctcggcctcctgagtagctgggattacaggtgcccgccacgatgcttggctaatttttgtatttttcgtagagacggggtttcaccatgttggccaggctggtctcgaactcctgacctcaagtgatctgcccacctcggcctcccaaagtgctgggattacaggtgtgagccactgctcccagccttatacaatttttttctcagcctttctttgtcttttatgactttaatatttttgaagagcccaggttagttgtgctgtttttgtttttgttttttctaagacaaagtctcactcttgcccaggcgtggagtgcagtggcgcgatcatagctcactgcagcttcaaccttccagggctccagtgattctcttacctcagtcttctgagtagctgggacttccacgagtacattgtcaagcctggctaatgttttttatttttagtagagacgaggtcttaccatgttgcccaggctgctcttgaactcctgaacgcaagcaatcctctcaccttggcctcctgaggtgctgggattataggcatgagccaccatgcctatccctgttgtccttgtttggcccagaggctggaagatcacttgaggccagaagttcaagaccagcctcggcaacatagtgagaccctgtctctttaaaatttaaaaaaaaaagaaaaggaatagcacagaagtggtgccctgccttcttagtgtcccattcctggagatgttggctttgatcactaagttaagggggtgcataccaggttcctccagtataaatttgtgtttgccctttacagtgaatgaatatcttataagtctgttaagactatgtagataccttatacttcatcaaactcccatccatgcttttttttttttttcttttttttgacacagagtctcactctgtcgcccaggctagagtgctgtggtgcgatctctgctcactgcagcctccgccttttgggttcaaatgattctcctgccttaacctcccgagtagctgggactacaggcgcatgacaccacacccggctaatttttgtatttttggtagaggcggggtttcgccatgttgaccaggctggtctcgaattcctgacctcaagtgattcgcccaccttggcctcccaaagtgttgggattacaggtgtgagccaccgcacccggccctatccacacatttttgcatctattccttttatatttatttacttgccagtctacagtaaggattatattttccttctcttccttatttattcatttatttattattggtatggattctggatttctgttttatccagtgggttataatctgtaactatcattattgtattgttcaaataattccagatttggccactgggagccctttcaagctagctcatgtgtgagtgggaatctatctagaagatagaatttcctgatggattgggtgggttgtgtgtgagagaaagctggggtttattcttttttttagagacagtgtctcactctgtcacccaagctggagtgcagttgcacaattacagctcactgcagcctccatctcctgggctcaactaatccttctccctcagcctcctgagtagcccagctaatgtaaaatatatatatatatttttagaaatggggtctcgctatattgcccaggctggtctcaaactcccagcttcaaagtgatcctcctgccttggcctcccaaagggctgggattacaggcatgagccaccatgcctggccaggttcatcttttggcaaatatttattgcctataagttgagataaaaacattataaaagcagacaaaggtccttgccttcacggggctcatgtttttgtgcatgtgacacttttgtttctgatccaagccattgggggacgatggcacagattttaggagggtggatcagtctggggcaggtgcagtggagctgcctggtagaccagcctctgcttccactcctccctcctccattagccccatgcttaccatgtaatgacttcctgctctttttcttcactcaacagccaagacaatgcaaactccagtgaacattcccgtgcctgtgctccggctgccccggggccctgatggcttcagccgtggctttgcccctgatggacgcagagcccccttgaggccagaggttcctgaaatccaggagtgtcccatagctcaagaatccctggaatcccaggagcagcgggcacgagccgcccttcgggagcgttacctccgcagcctgctggccatggtgggtcatcaggtgagcttcacgttgcacgagggtgtgcgtgtggccgcccactttggagccaccgacctggatgtggccaacttctacgtgtcacagctgcagactcccataggtgtgcaagcagaggcgctgctccgatgtagtgacattatttcatataccttcaagccataaagatattgtgttcacttttctgcttgaggctaaggcactgtatcccaggcctcccaatgttcccgagccaggaactctgggccccatggagttatgagctcccttggaattttgagccaagctttaagcaagtctggactcctgagacctcctgggtctagtcagtaaaattctgcaactctaggaattctaagatcccattggaaggaatgctctacctcacagaactctgaaccctacagaaatatgggcctgctgccatttcctgaagaccggggcatcggggtggggtgataaaggatacaacctgcacagggggaagttattaaagaggctgcaaagtccagccaccctgaagatactccccagtgctcccctcctgctaaagaaccagttaccccaggaaaattcgactcctgtttttctttaattaactataccgacggggatggagtcatctttaggggctggtagggtggttatccaagggctgaatccagtggagctgggccaagtacgacaggagtccagataaaggtgtaggggctgcacggccgcaagtctcctggaaaggctggagtgaccggcatgccgggattgggagattaggatttgatttcattttggggcgggcggtggctcgtgctgggtcacgtggtcgtgcccaagcgctcctcctgttgccccacctgtggttgctgtggactgcacacgacagcagattcgctgtcccctcgttggaggcgaatggtcggaccccgagtggcggcgcccctgataaaaggccgaggattcgcgatcagggtgcaacttcactccctcctcttttctctccagccttgcagcgtggccgttcacatcacgcgcttcactaagcctcctatcactagtaacctttcagcgcattgtttaaaaagaaagcagtttctgtccctttctgtagttcctttaagttcaggatgtaagcgaagccttccattaagtaaaggtgagtgtcgtttcgtctcagtcgcgaaagtgcggcggccgatgatgaaccgcgccaggagcagcctcagcggccatcagtccattcgcagcgccggctccgccgaggcccggacttagctctcgagttgccttggcgacgacgcagctcgctccgccccagttcccttttatggtttcagccccgcctcctctagttagccgggtgcgcttcggcaagcgtggcgaaagtgcggcggcgaatgtcaagcgttgggtctgagcctaggggtgtggcttgagctcacgctggttctttcttgcctcggtgatccaccagccttgtcacccaggatttaggttggcagattcgtctctcgcctttggaatttctaccttctcctaggttttgttttttaaaatcaggcctatgataccgctcatgggctcatatttattttagcattgtaatttaagttgtattttatgcaactctaccccgatacagagagctgttgatgtaactgcagcgagcaaatggaggactagagactagcgaaggggccgagacttcgtctccagagtatccctgtcagcatccatcaactgcactcatatattgaatgcagctcctatccgcctttcttttcgacttcttcatgccgttaccactcttcatcagttagtctagcctcaatgttttcatttatttcctttgttttttttgggggggggggaacggagtcttgctctgtcgcccaggctggagtgcagtggcacgatctcggctcactaaaagctccgcctcccgggttcacaccattctcgtgcctcaggctcccgagtagctgggactacaggcgcccgccaccacgcccggctaattttttgtatttttagtagagacggggtttcaccgtgttagccaggatggtctcgatctcctaacctcgtgatccgcccgtgtcggccttccaaagtgctgggattacaggcgtgagccaccgcgcccggcccatttctttcctttcgttgagacagggtctggctctgtctaccaggtcggagtgcaggggcgcgatcatagctcagtgcagcctcaacctaccgggctcaagcgatcttcccacctcccaagtagctggaactacaggctcctgtaaccagaccctgctaatttttaaattttttgtaaagacggggccttgctatgttgcccaggctggtctcgaactcctggactcaagcgatcttcccgcctcagccttccaaagtgctgggattataggcgtgtgccgccgcgccccgccaggtgttttcagttctatgcactccattccctgggctcttgacgaatgtgcgggagctgaatattcgttatttggactccggcaggaaggcgtgggctcagcttcgcgcttgcgcgctgctcttggagacggcgtctacttcgccccgcccctcatagtctgcagttccggctctgcagattcgctgctcacgtttcttttttccgtggcccttcctgccctttgtttctctcttcatgtcacccgcgggacaactctacgtgcaagtcgctgaaatcgattttctgcttcttatagtaagcggcgggctcgccagcctcgagcgaaagtgtgactgcgaacgggcaggcgcgcgcggggctcggcggaggcgcgcttgggctcccggcggcgacgactacgaccactaggagagcggacggaggcggcgcctgaagcggcggcggagcccatgccccgggacggcgggcggacccggagagacaaatccggggcccggggcatgtccccggggcccccgtgaggaggcggcggcggctatggagatcgcgccgcaggaggcgccgcccgtgccgggcgcggacggcgacattgaagaggccccagctgaggccgggtctcccagccccgcgtcgccccccgccgatgggcgcctcaaggctgcagccaagcgcgtcacattcccgtccgacgaggatatcgtgtctggagcagtggagcccaaagacccctggagacatggtagctaccgcgggtgaagcgggggcgggctcgagagggacccgggagtcgggagggatcggtgcagggcccggctcgaggtggcgttcaatagattgcacctaatggtgaataaggggacagtcgtcagtttagaaccgtagtctgttagaaagggggtggctatggagttgggaaggtgaaaagtatctggtttctgccgcaccccacccacccgagacaaagatggtgatcgttttagggtttaaaacgatgagcaattaaagaaagtttggtgttttgtcagatgtagagtgtggcagcctttgcgttcgtagttccaccagagaaggagagaaggagcagttgagaggaggagcgggtcaacactgggcctgaaagggcagttgaaagagtttgatgggtctatgggggtaaaaagaggttaagttgctggtctgcaagccttggggcaaggagtggtcgtgttggccactttcttggctggaaagagggagactataaacttggactgtggctatagaggacttggtaaaaaggagtcaagataaggtcccagaagaggagcagaggtggtggtcaatttgtggttgggtgagggagaaagaggcagtgtggtttttatgttttcttttttattgagacaaggtctcactacattgcccaggctggtctcggacttctgggttcaagctgtcctccctccttggcctcccagagtgttgggattacaggtgtgagccaccgccgcctgctgcaatgtggtattaagaagaaaagccaacgcctaccgccgcctcctcctccaaaaaaaagagaagcagaaggaaggctgtcagtcattcaggagcagaggatgtttgggacatggctacggaagggtcctcttgttccttcctgagaaagaattgggggatggccgggtgcattggctcaggcgtgtaatcccagcactttgggaggccaaggtgggtggatcacctgaggtcaggagtttaaaaccagcctggccaacatggggaaaccccgtctctactaaaaatacagaaattggccgggcatagtggtgcacacctgtaatcccatctactcaagaggctgaggcagggagaatcgtttgaacccgggaggtggaggttgcagtgagctaagatcacgacattgtactccagcctgggtgacaagagcaaaactccggctcaaagaaaaaaaaaaaaagaattgggggatgttatcaagtcagaaattggagttgctggccagtagcaggtgagagagatgaaaaagttggctacttgaagtgttgggagagagggccagcgcactggagagggtcaggtcagtgttggagctgaaaggagtgtgttggagccatagggctgggaaagtggaaagtcgcttgggacatgcagggcagtgttgagtccattttgtgctggagaagtctgtcagttctcctggggtggagcccatgaagtgagggatcagactggctgtggtggccgtggttctgtagaagctgatctgccggccctgggcaaggggagaaactattgccagtctgtggacaatggaggaattggtggctttgatgtgagggtgggaaacatggtaactggaaactgaacacacagggagtccatcatgaatgacagtttggctacttattataattttttagacggagtctccctctgtcgcccaggccaattctcctgcctcagcctcctcagtatctgggattacaggcacctgtcatcacacctggctaaaaatgtttgtatttttagtagagttgggggtttcaccatgttggccaggctggtctcgaactcccgacctcaggtgatctgcccacttaagccttccaaagtgctgggattaccggcatgagccaccgtgcccggctggctagttattcttaaagaggcagtggttaaattaagacttttgggccggacgccatggttcatgcctgcaaccccagcactttgtcaggccaaggtgggcagatcacctgagcccaggagttcaagaccagcttgggcaacaaggtgaaaccgcgtctctgcaaaatatacgaaaattagccaggtgtggtggtgcacgcctgtagtcccagcaactcaggaggctgaagtgggaggatcatttgagcccaggaggtcgatagtgcagtgaactgtgattgcgccactgaactccagcttgggtgacagagacccggtcttaaaaaaaaaaaaaaaaaaaagagttttggcactaggagccagccaagtccttgggctctaggccccagggataggtggttagtttgggacccgggcacagtcagaatgccccctggctattgcgtgatatccagtccagagcaggaaggggaaagacctggagaggcagagcagggtgtttcaagagcagaggctccaggtcagatcctttgagacctcgggctggttacctaactcctgagcctcagtcttcccatctgtgaagtaggtggcaatactcttgccacggaatttaggagaggactggatgaagtcacatatggaaaggaattggccagggtgagtgttctcgatggcagtcattgttattaagacagtgttggtcatcttgggctggtgtggaggagttcatgcatggggtggggcctggatgtggctgcttcagaggcttccaggagaggggagagatggcagtcaatgcgtgggcctggagtgaggtgcgagggggaagatggtcagtttgtgggctgaagggtcaggggtgagggcagcaagagagtctggcacagattgggctttggggggtaaagtttctggtctgcagattcccagaacaggtttggctttcattcagtaagccacttttcctctccaagcctctgtttctttctctgcaaatggaggtgctaatttttaccatggggtagttgtgaagatgaagtaagatagtcctcataaatttctgccacataaatagcagctgtcatccaggcagatttgttttttgtttgtttgtttgttttcacgtgcagtcttgaagaggcagtgaaagaactggagaggcagaaggctatctgtcaagaaaagaggggcagttggagcctggctgggaggagtttagaggaggggtgccggttggtctgtcctgggtaaggggtagagtgggtaacactctccaggctgggggagtctctcattccagcggttgagagaggggcagtaaggtctggttgggactcacactctcgaggagtccgtgcgtctgagctgcagaggtgatgacatggactggactggaagaattggtccatcctgtttgggaagagggcttgaggagttggcttggcagtgaggagttggatgatcttgggcctgggcaggggaggggtcattggtgaagttggtgagtttggacaaagggatttgcaggacagaaaacccaagggcctgggaacagcaaggagcaggggttaggctccatgctggggaggacgatggagtggttcactggccatggggctgtgggaggtggagggttcgccagggtgaagaggaatcgtggtacagaaagtgggtctaaggggaggcccaagtgagaggcccagagggtctggggctggaggactgcagggaggggttgcttggtcttggaacagaggtaggagatttgttggcatcaatctcataagctgtggggagggacagggggtgtcatttgagctgtggatctagtggaagggtggcgtgaccccaaggccaaggggtaacagaagagctgacaggtctgaaggggggagactcagttatccggaagctgttgtgccgtgctagagatggagcgctgcctaggccaggggatggaggagcgcccctgggtgaggaggaagcagcactgggggcaccccagtgcaggggtctccttcagcagagcctcacccctggggctacagtggtggcccagctgggtgggagctgtggggggtgtctacctgagggtgagcgctccctcaggccctgcaggggcccagggtttggggattcctggagatgaggtgatctggaggagggggattgtgagggagggtctcgagcctgcccaggcttatccggattcccatctcccacagtggggttccgcctgctggggctgctgtttcctcattacgtgaatggccatctgatgttcttctgttgtgtgcttgttttcttggtggtggtctctctcccgcgctggaatgggagagcagaggccgaagtccatcctcttctccgctttcctcaaggacactcagttgttgaatgagcgcctgtgggcccgtgaggcctggtggtgtctgagagccacctagcagagtgacatgtagctgaatgtcaggggcctgagcagcctggcgtggggatgccagtggggcagcagtgtgctctgtggcctctggcaagcatgggttcttgcagagcattgtgtttcctcacctgtgaaacagggccagtgatccctgccctgcagaccaccaggatgtcagaggatagggtgaacctgctgggggcaggtctcctcagcaagccacagccaggtgtgtgtagatgggcagggaagctcggggaggaggcaggctgggaatcgtgagtgaaagaggccgcttcagcactgccaggctgggcacgtgggtgcccgtggggagcgagctagccggctgcactgcaccccatcatgttgtggcagacccttcagctcttctgaaggccaaggccagacttacacaaggaacccatcaggccaaactgcaggaatgacctgaggctcggctggtctcctcagtcccagctgaactctgtggggttggaaagataggcatgtgagagggacttgtgatgagagcacatgacaccagccacagtccgggagactcatctcccctcctccagtcctgccggtgactcactccctgctccctgaccatcagtcctccagtgtgtgtgcgttgggggtttgcccactaggaagctacttgcatgaagtcaaggtgtctgcagggcagggtgagggggcccaagcatgctaccatctctggccacctgagctttggaaggcagcgggaggggtgggggcagggtgttcttaaatgcggatcttagggcatggaaatgccatactgttggctattgaaacccgtgctgcagattcagtcctaaaagcaggctggacaggtagacatgcatctgtcagtggtggaaagaggccccaggttagagaatcggcttgcttcagcattcgtggtggagctgctggggagtagggaacagggtcgaggcgggtgctttgatgcatctgctcagatttccgtctgggcccagctccacctcctgctgctggagttggcaagtagaccctgccactgagcagccacgtgactttggcgattgttctctctgcctcgatttttctgtgtctaaaatgcagcagtatgtcctcatagggtgattgggaggattaagtgagataacacagtgcctgatccatagtaaatgcccagcaaatgcctcccttgttattcctgtcatcaccactcctctgcccccacctatagccctaacattttgtttctgtttcctgcccgtgttgtgtatttgtactcctctttcccctatagtgtcccacgtcagcgtccctgctttccctcagaggcccactcctccaggctgggtgccccagcagtccctgacctccaggcctgactctgtctctgccaagctgtgtgaccgtggacaatttgtccaatctctctgagctaaaactaaatcagcctgtctcagcccactagtagaagaggcagcaggggtaccaagattccacactggccatgttagttccagcttctgcctactctggctgatgactttggacaagttgcagctcctccctgagcctgagtctcctctggagcgggggctccaccaccccagccccctgccctgttggagcatgatcaggttagtggtggtattgtgctggtgcctgtcctctgccctcccaggccctttgcacactgtgactcgccgctctccgtgcctgtacatgcagttgggccgcctgattctttgtgcctgtgattatctgtgctcgcatctatttcccccttcaagggcaaagactgtgtatgagtcacctctgtgaccctagtctagcacacaggagggctcgggcacgggacacatgtccgaaggactggggtgttttcctgggatcaaacaccccatggtgggatttacaggaaactttttttgtggtagttaatccagttggtgccaggacgaggactctttctcagggacctacagacaggctttagcacccattctgactcccggaagagcacgcgaagctggcccccagctggcactcggtaaccagccttcagtgcgtcagcgggagtgcgtgtgcacttgtttctgggagcgagtactggggctctgcgaaccttcacaggcatccgactccaagaggattaagaaccgtggggccaaatgccctgtgttggacggactgcagctggagcagtcactgagcacggaggccagaaacctgtttttacaaaagctccccaggtggttctgacaacctcgcttggctgtctgtgtgctttgctccgccatccatcactcagtcccaagcctgccttcagacctcagttcaggggtggctggcattgacctcaaagccttttttggagcaaattaacaggtgagcattgaaatactgcagaaattcaagctgagccggccacctgctgcagtagggcatgggggcaggtgggttaaattcttgccttctggctgaccttagtcatcaccagtcattgccttccatgtgcctgtaccaggcactggtctcagtgccttttgtgtattatcgcatttagatatcacagccaccccaggaggtaggtgccgtttgccccaatttgtagatgaggaaatggagcccatagaggtaaagtaattttcctgaggtcacacagtgggtaagtggtggagctgggattcaaatccaggcagccagcctggcgccgaagcctgcgcagtaataacccctgtgcggcggctgagtgcttggacgcattcggtgcaacgtgccatacggtctcttcatctataacccagaatcgtttataaaatagaggcaacagtgctggctttgcggtgttgtggcagggaggagaaacagaaacaggtggggtaagggcccagccttggtgggcacgcaggagggggtcactgtggttcgtggacagcttgagtccctggagatttgtgctgctcctctgtcctcagcattgcctgctgttctgacccttggcctctgggacgtgttcttcctgtgctactcagtgtctggtatgtgataggcgctcaatatattcttgctgcgtgagtgacttggtgaccccgtaaccagtcatgcattcagcatggtgtggccgtgccacgtgttacgagtcagggcagaagacaggcccagtccatgcttctgtgggggtcacagtcaagtgagggagacacacagtaaagaattctcagcaaaccaggcttctgaggactcagattagggagggtccacagggtgtgcaggagggcagggcagaggcagcttcctagaaaggacgtcaccaaggaaatccagcagtaagccaggtgaggagcagtgggaggagtgcaccaggggtggaaggcagagagaaccagcctggtatgtctgaagaacagaaaaaagccagacttagttgaggtagaggcaggctggtcagaggtgaggctggaggaggcaggagagactgctgtgtggggccttatgggctgtgctagcagggagccccagagggcttaagaaggggcctgggctgggcatggggggctcacgcctgtcatcccagcacttcaggagctccaggcgggaagatcacttaagcccaggagtttaagaccagccttggcaacatgacgagaccttgtctctacaaaaaatacaaaaatcagccgggcatggtggcatgtgcctatagtcccagctactcaggaggctgaggtggaaggatcacttgagtccaggaggtcgaggctttagtgagctgtgatcacaccactgccctccagcctatgtgacagagtgagaccctgtctcaaaagaaaaaggaggggcatggtgggtgtttttaacagaatcctgtgtggaggtgacatgaatagggtgagactgagacagggaggccagggaggggccgtgagccaggagcccggaggctgtaggcttggcgtagcctcatattggctgatagctgacacttgacttcattgacttcttcatcagattcctctgagtcctcccctccaccagcaggtttgccgatgccactgtttcccatagcacctctgaggtgactgttattccccttcccttctctccttggatctgagtcccttccctcgtgctcccccagccagcgtgtccttggcctgcttgggacatcctgcccctgcatgggctgtgggaggcgtgtgggctgtgaagtccggtgacctctccagtgacttcacctccacagtcccttcaggtctcacagtacccagatccagaaaactctacagaccatcccaaacccctctggtggcttagcgcaatatcggtgtctgatcagtcttataaaatccagaaaattctgattctaaaacacgtctggcccaagggttccaggaggagactctggagcccgcagcgggcctcgttccatgtttgtgaaatggcagtaacctgagaggcagcacgggagccccctgggtgccagtcccagctctgcccttgggcaaatcacccagcttctttgcctcagtgtccccatttgtatggggattgaggattaaattagcctctacttggaaagcagctggaacagtagctggctgttgcaggcgctcatgaggacatgggaaagttgagtgaggtggtcactgccttgaacttgactggttcctgcctcccccggctgtaagggttaggcaggtggggctagatgaccagcgggtaggatcatctgcctgagtgtgatttcggctcctccacacttgggctgtgtggccttgggcaagtcccttgacctccctggaccactttccccatttgtgaagccattttgccagatgaggactctctcaaagtttttagactctctgggaagaccagagagccaggcctggggcccacgccagcaggagcacaccctgcatcaagtgtggagctgatgccgctcctgttacatagccgccacagcacctccagggctgagcccacgtcaggctcctgggctggagccacacaggaggctggggtctgctgtttcagctaagaggaggtgggagatgtggaggggcttccctaattgcaagaaggtggttcagaggctgggtgccaaaaggaattcgagagatccgtcatgcttggctatgtttcgtacattaagtaggaaggtccatgaaggcaggacccatctttgtcttggctcacctgtgtccccagcaccctccatggtgcctggccctccgcagggtctcacactggatgaattggtggtggatggaggtacacagtaggcactcagaagttgttctcaccccttcccttcctctaggcagctggtactgagcggttgcctcaaggtgggggtggaggtttggaagtgtctgctgacatccgcacagctcatgtgacttgcccagcgcccatctcacttcgcagcggaagcctgggtcgggagccctgcagtcggatgctcccctcagggctggttgggttccagctgggaatgtgttccctggttaggtgggcgggctcctctagcaagctggcgcttgggacccgccggggtcggactcgtgtgccaccttcacacccacccctccctctctccacggtctccgaggctctcaccagctgctgtcagcgatgtagtggagaactgctcgcgtcctgtgcagtcttcccttttgcaaagcaaagcactgtcacagctgaactcgcttggttccccaggacaacagggagggagggtgggagagtggggctgccaaaaggtgaaagcgagccgcagggaagtgactctctgcaggggtcatgcctcctggtggtggtgatggaggtgatggtactcaaagctcccatttatggagcgcttaacagggctaagctctttacatgcatcgttaatcttggaggaggaaacaggctcacagaggtgccaaggccacacaggtagtagaggaggagctgagttatagcccggcagcttgaatggttctgatcctctgtcctgtttcagaaagcccccagggctccactgtaactacaggacaaagtccacacccgtgggcctggtgtgggaggcctttcccacagaacgcccagcctcctagacacaggcgcctctgcctagcacgcccctcgctagtcccctgcccttcctgaccaattcccgttacccctcccacgcctagacgcaggcgcctttgcccagcacacccctcgatagtcccctgcccttcctgaccaactccccctcccgtgctgccttctgggcaaggccttctctaatccccggacaaagctctgctccgctcgtctgggttcccatggcgcctcctcgctctgttgttatttgttcgggcccatctcccctccctggaccagtgctgcagagggctgcatcctgtccatctggctcctgggaggggtggaaccactgaacgcctccaggaaccttaaggactccgggcaaagtggggttgcttatgagcacccaggccgggtgccgcaaagcctttgtaacccaggcactggggctcaggacagtcagggagcatggggtgtggggaaggaagatttcgttcactgagtccttttttcctgcattcattccttcattccttgccaaccagcgcctgttttgcctccactttgctgtccctgccatgccaggtggaggggcctcccaatggctctcctgctccctctccaacccgctccccacctagcagccacagcattcttgaaaaagcagactttgctattcctgtttcacatcacacttgtgacctccctgctgcctttccctctgatctagtgtccctgcaacaggttaggaagcccaggtataacctggctcttgccaccatcgccggccacgaccgagatcaccttgccatgctcttgctgggttcaagccatcgtggcttcctttcagtcctagaacacgcaggcagctccccacatcctgtcctggaagaccggccccacctacgcacacaggtggctctcactaatctttcaggtgccagcaaacccttccttcctggccctcctaatgggctccccgtcaggtggccagcgatctgcttatctgcgggcctgctgatactcttgccctggactggaagcatcactaggcagtggtgggttgggtttggtgccactgtattccccagtgccccagaccacgtggcactgggcctggctctgggcaggagcgcaatatggcaggtggagaaggaagtggcatgcaatgctgggtcttagtccttgccatgagcagctcagacagtccctaccctagcatagtccctggtccagaaaaggaagtgggcagagaggaggaggagctttagggaggggagtacaaagcctgcctctggtatccccccgccagcctggtgagaatggcagcgcaggactggcaaacaggcccgtctttgctgttgacttgctgggggtcataggccaggatgcttgccctctctgtggggcaggatggtgcccggggtcctttcccactgcgcgtcagtgtttcccatctctccatgtaggacaccgcaccatttagggagtgattggatcccaggacctcctccctgtcacggggtggcaggcaaggttctgataattgatctgccgtgtacctttgtggcaggtgacctaattccccattccctgtgacccatgtgtcacaggtgtcaggggcgaccggccacccagccaagcttccatgactccgttctcactctgtgttctgtaatccccttctgtcacgggcttgggatccttgattcccggcccggttctgcctactatgatcacaatgaacagtcagtgttccgtttccctggagggctgccttccttgctgtgcctggacctgtgttccctgctggacaagtcccagggggtcaggcccggggctttctcggtccctgctgtgtctcctgcacagctccaggcacagagcaggtgttcagtaaatgttgttccattaaaatggagttggggctgttgctggcagagcccagggacagcgccctcatggagcctggcttagagtgcccaagtctgacagtggcctgatcctgtctggtcctggggtggagcagacaccaacaggcggggccatctgactgaatgtcctcccaccagctgttaggtccaggtgtttgtgcttactgccttccagtgcagtcaaaagaatccagggctggcaccagccccttcctcatctcaggggtagaggggtaaccagagaggggcggcacttacccaaggatgccctggcacttgggtccaggctcctgctgctctcctcggccacccctccagctgttttgtttttgtttttgttttttttttgagatggagtttcgctcttgttgcccaggctggagtacagtggcaggatcttggcttactgaaacctttgcctcccaagtttaagcgattctcctgcctcagcctcccaagtagctgggattataggcatgcgccaccatgcccagctaatttttttgtatttttagtagagacagggtttcaccatgttggctgggctgatctcgaactcctgacctcaaatgatccacccgcctcggcctcccaaagctctgggattacaggcgtgagccgccgcgcctggcctgtttgttttgagatgaggtcttcctctgtcgcccaggctggagtgcagtagtgcaatcctagctcactgcagcctccacctcccaggctcaagtgatcctcttgcctcagcctccagattagctagaaccacaggcacaagccaccatgcctggctgattttcttatttttaattgttttgtagagatggatttgcaccgggttgctcaggcttcgttgtgcttttgatttgcatttccttatggctaatgatgttgagcatctttttttttttttttttttttttttttgagatggagtctcgctctgtcacccaggctggagtgcagtggcgtgatctcggctcactgcacgctccgcctcccaggttcacgccattctcctgcctcagcctcccaagttgctgagactacaggcgcccgccaccatgcccggctaattttttgtgtttttagtagagacgggatttcaccatgttagccaggatggtctcaatctcctgaactcgtgatccgcccaccttggcctcccaaagtgctgggattagaggcatgagccaccgtgcccagctgatgttgagcatctttttatgtgcttgctgaacacttgtgtatcttctttggagaaatgtctttttagttcttttgcccatttttaaattgagccagccgggcacagtgattcatgcctataatcccagcactttgggaggccgaagagttcgcgaccagcctgggcaacatagcaagacccagtctctattaaaaaaaaggggagccaggcgcagtggctcacaattgtaatcccagcactttgggaagccaaggtgggcagatcatttgagcccaggagttcgagaccagcctggacgacatggtgagaccccatctctataaaaaaatgtaaaaaattaaccaagcctggtggctcatgcctgtagtcccagctacctgggaggctaatgtgggaggattgcttgagcccaggaggtcgaggctgcaatgagctgtggtcttgccattggactccagcctaggtgagactctgtctcaaaaataaataaaaaataagtaaatgaattgtttgtcccttcattattgagttgtgagagttctatatacgtgtatcccggatgcaggacttctcagctgagcgatttgcaccacctgggatgttttcagcgtgtaatgccagtgcatttccttcccgtctcttctctctggctagattcacagccaccgctagataaaaataaagctgtgaggatactgtagatacagttgaatatcctgcttctgcacttcatttttccgtttttttagaaagcatgatttaaagtacatcactgggctgttgtaattcattctagccatttccgcattgctgagcgtttaggtcctttccagttttcagttgcatagataatgcagtgatgttcgtccttgtccataaatcttcatgctcatcacacgggtagccttcttagaaaaaattcttagaaggtgattttaccaggtcaaagggaaggaacattggaagtctcagatactggctgtgcccacattggacagtgagtgttgagggctagggttctgtcgtcatagtcaccactgtagctttagatttttttctgagagagggtctctctctttttttctgcttttgaggtttaaaccatggccagagacagggtctcgatctgtccctcaagctggagtgcagtggcgtgatcttggctgactgcaaactccacctcctaggctcaagccattctcctgccttagcctcccgagtagctgggattataggcgcgcaccaccacgcccggctaattttcgtatttttagtagagacggggtttcactgttggccaggctggtctcaaactcctgatctcaggtgatctgcctgcctcagcatcccaaagtgctggaattgcaggcgtgagtcactgcacctgaccagattttttttttaatgattgaatgaatagtatttgcatgtgggtgccttgatgttaagatggtgtcttgttttagcgagcgttcttttgactactagttaacttcggttttgtttgtttgttttgtatttttgtgggtttttttttttttttaatggagtttcactcttgttgcccaggctggagtgcaatggcgcgatctcaggtcatcacaacttccgcctcccaggttcaagcgattctcctgccacagcctcccgagtagctgggattacaggcatgcaccaccacacccggctaattttgtatgttttgtagagacaggatttctccatgttggtcaggctggtctgtaactcccgacctcaggtgatccacgcgccttggcctcccaaagtctgggatgacaggcgtgaactaccgtgcctggtcttttttgttttttgtagagatgaggtctcgctatgttgcccaggatggtctcgaactcctggcctcaagtgatcctcctgtcttggcctcccaaagtgctgggattacaggcatgagccactgcgcccgacctaacctgtttattgttaacatgttacatggttctgggaattggttcttcatgccctttgcctatttttattttgggacctttataaggactcctctattgaagatagatgtaattttattgtgcagatatatttgtcctcatttatcatttgccttgcaggaaaggtgggggacaggggtgcaggacactaaagagaagcactttctcctctgctatttcaccgagtcatcatagcaaagccccatctcagtgtgaacagcttgggatggagaaacacagggctggggccctcagagagggcagaggaggcagtggcagcccaggccttggaggccctgcagtgtaggagagagggtgctttagtggaggcccggcctgggaaaagggttagcaggttacagagggtccactgtaaccacaactccagccccatttgctgagcaccaggctgagtgactcggtgaacctgctggtgccccacatttttgcagataagaaactgctacttggggtcattggtcacttgctgaagatggcagaagccagggcagccctgcctgggtccctggacacatccagcccaccacagctatggaggctcagcaagtcccaggagcctcaagtttcagcaggagcctggactccctcgtctcccacagccatggccaccacgtcatcagcaccctctgtatgagggtcctgtatgtcatgtgctgtttccttccagtagcttcctgactcttcaggaatactgttctttgccctgaggatctgtcgcccacctgcatctgcagcctcagctctgctccccctctgccctgttggagggtcctcagaaccgactcttccctctgtctggaaggatggcctggacttttgtgtggctcctgttggcttatggcctcctgtccccatccagtgtaagcttcttgagatgggatgtctggcttttttgttcaccagtgtagcctggcacctagaatagtgcctggcatagaatagacaacaataaatatttgaaggaattaatgaattccctttttcttttttttttttttgttgagacagagtcttgctctgtctcccaggttgcagtgctgtggcgtggtcatggctcactgcagtctagatctcctgggcccaggtgatcctcccgcctcagccttctgagtagctgggaccacaggcacgtaccactacacctggctaatttttggattttttgtagagacggggtttccctgtgttgcccaggctagtcttaaattcctgggctcaagtgatcctcctgccttggcctccgagagtgctgggattacagccatgagccattgcacctggccacatttcttacttttactcatcttttaggtctcagtcgaaatgttcttttctcttatgggtcttttctaactattcctccaaatctgaatttgtatcccctgtgttttcccctataatatgcattttcttcttataactggtaaatttttgggtgatttgtttgccttcctcccagtccttgagggcagggaccagccctgttttgttcacggctgtctgcctagcccaggttgttgcataaagaatgaatgaatgaaaatatgttcattagttcccaaacagacctctgagggttggtggcattaccctcttgttatgaaggaggaaggtgagggtgggcagtaagaaattccaagcacctggtttccatcactggagcctttgctggaccagtaaacagcttacagtttctaaaattccaatctaaagcactcccaaagcttctgaattcagatggccatctggtacccatgaccagaagcctgaggcaggtggcccgaaatagcctgcctggttctggcaggactgaatgtctaccgatgagtgctgggctttcctcagaggccccctttcccgagcctggccctgtcacctactgaggacttgggtgggtggcagtgctaggaagcattgagccactaaatgactcagcaaacccttgtcaagcacctcggtgcccccagctctgctgagtcctctgccggattgtcttgcctgtatgctcatttgaccctgacagtgatcttcagttccccaaggctccaagagctctgtctcctctgagcctttgcacatgctgttctgtctgttgcaacactcttctccctcccttctgctttttaattattattattattattattattatttttaattgagacagagtcttactctgtcacccaggctggagtgcagtggtgcaatctcggctcaccacaacttctgcctcccgggttcaagcaattctccagccacagcctcctgagtagctgggattacaagtgcgcaccaccacacccagctaacttttgtatttttttagtagagacaaggttttgccttgttggccaggctggtctcgaatcccgacctcaggtgatccgcctgcctcgatctcccaaagtactgggattacaggcatgggccaccttgcccagcccatttatcttcttggcatatggaatatgtatgtaatgtacatgtaagttgttgaagtgtaatatgttgaagacctgtgagcctccctcctaatttcagagtgagaacattgccattaactcacctctgcctgtgggtgggtggagggagcccactgtcctgactgttgtcattgtcattctgtgttttttattttttgcggggggcgggggtggatgggtgagggacaggtgtgtcaggttcaataaaaagggaaagggtcatcaggtggcctttttaaaagttttatcaaccatgtctgcatgctgaaaagcatggtgtttcgttctgcctgtttttgagtttcataaacatggtattgtgaggaaattcctgggtcttggtttttcttttctttctttttttttttcttttgagacagtctcgctctgtcgtccaggctggagtgcagtggcataatcttggctcactacaacctctgcatcctgaattcaggcgattctcctgcctcagcctcccaaatcccagctgggattacaggctcctgccaccacacctggctaacttttttgtatttttagtagagacagggtttcaccatgtctgtcaggctggtcttggaactcctgacctcaagtgatccgcccgcctctgcctcccaaagtgttgggattacaggcatggattccttctgatacatttcacctggagtgctgggatgacaggcgtgggattaccttctgatacatttcacctggggcgtgagcaagactttcgctagagtctggagctaggaacagaatggctggtcatagttgatgagtacatttggcttctcaaggtaatgccaatctttctgaagtggctctcgccaccttttacctgactgactcctgcttgttctccaagagtctccttcctggctgtctttccttcagcacctacttaggggagcagcagctgtgtgcctagtgtagttatgttctggggggcaatgcgaacaagactcacagtccctgccctctagtggccagtggtgttagatggtccctctttcaggacgcccccaaccccaagtctgggttaggggtttcctttgccccagctctacctactctggcttgtcactgtctagggatgggtctgccttcccgactggaccaggactcctgtgtggacagagaccaggattagggttgtcttggacgctgtttccagcatgaccctgcccggggcacagagcaggtgctgggtgaagcaggtgctgggtgaagcaggtactgttgagcttgaggcagttggggtcaagaggaagaaatggattctagtatccaggactttctggagtaggacctggaccccaaggccatgtaagcccaaagcctcatactttccctaatgcctgagtgttcaagattcctttacctgtgctgggctctgtggcagagggaggggtcacagctcctgccctcgacagcttagagaagagtcagtgcctaactacacaccccttccatagtgtgcagggctggggatgtgcggctggcagggtcctcacagagaaatgtgaagcccacccggccctctgggagctcaagtgttggcatgtcttttctgaagagggtgagggcaggaagatgtgcattacccttagaaaaaaagtagaaaaggccagccttctcatgcagtgccagagcagttagggctgtatgggggccactgtgggcctgtagattcgtaacaggaatcataatagctagcgttggtggaacacccactgggtgccacgcatggcgttgagccctccgtgcatcagctggttttatcccatccatatcccacgaggtaggtggaattgctgccccattttaccaatgaaggagagatccagctcctcacagctagtcagtggcaaatctgaacttcactcctggcagccagagcccagcccctgccctgcacgatggtagcagagcctgtctgcaggcaccaggcattcagagagctttacctcctgtcctcttgactcttcatggcaaagctggaaatggggagactgaggaacagagttacttggccccagtgctgcctctgatttgaggaggcagggtcagccctgggccatcgctgcctttgtccctgagtctgcgttcccctccactccgtgagctcactcagagagttctctccgccccctcaccactcttggtgattatttatccccaggtcttcacttcggcaccatcaggtgcccagccctgggtaaatatttgtctcagggcagacaggagtgggtgtggtcagcgtttcagagcccgggggcaggtggaggcagcaggtggggtggtgactgggggcccctggctggagctggtggctctgcttgctctttgctcatccagcatccactctcccgggggctgctgaggcgttggcctctgcaataacaggggcttccgtttgccacgcgccagccccacactagacgctttacacaagagagttcagtggctgcttttagaagtctttgtgtgtcagtctcagtctcattggctccattttgcagatgaggagactcagccatgaagggtcgagagccattgcctgtgtcaactggggtctgttgagttatcagggccagaatccacctggggccacaggaggtgaatgagggtgttcattggatggaggccaggctttgcctgttcccaggggtcctgaaagctggcaggaaccaggtctgccacctgctctctggaacacatgcactccttgttcctctttctctcttcagaacgtcttccactaggctggccatgggccacacaagcccagccctcctggtgtctggaacaggaccacccagtccagccccctgacccgggcagctcatgcaggcttagctaggaccccacatcctccctgtcaaatgggcgatagagggccagcccacgcttgttggggtggagggcagtttttagaggaggctctgcagacaccccaaataggcacccccaaatacaaggtctgactgcaaaggccatgccctcactaggttgctgttacatgtgtttagaaggtgcattcacaggctgggcatagtggctcacacctataattccagcactttgggaggccgaggcaggaggatcacttgaggccaggagttcaagaccaccctgggcaacaagtgagacccccccccccatctccacaaaatataaaaaattaaattttcggaaggtgcattcacatcacaaggcagaaagtcactagtgtcctcagatgtgtacatccctttgggaagctccttccagctggggggcttatggaggccataaaggaaccccctaactccccctacacatcccagcagaaagccctgggctaggggacagtcttgggcccttgtgttctgagagtgttattagtctccaccacaggattggctgtgttttcttagtggttcaggcatgcattcagcgagtattgagctcagtgcccagtcctgtactggggacacagcagtggcaaggcaagcccggccctgccttccaggcttattgtccagagagagggaagtgtgggaaacaagttggccaaccagcagacagcaccactgcagattgagagaagggtctggaaggaaataaaccaaggctggaacagaggagacagtggcgaggctggtgggtaggtacctggcttgggtcaggatattgaacgccttaaactcttgggtgaggcatggggtccaccaaccagatgaagtgggctttgaagtcaggcctacctgtgctgtgtgtccttggcacatgctccatctccctgcgcctcagtttcctcctttggaaaggatgggggagggatagctgtaccccaaaccgtggcatgaacagaaaggtcaagggtttggctaagagtgaggattgtggagccatagactgctcaggctcgaatcccggctctgacttttactgattctgtggcctcagtttccccatttgaaatggggataataaaccctacctatcttagggttgttgaagacagtaaatgaggtagtatatgtaagtgcttgccattgctcgtaaaaattatttatcgttaaaagttgcggccaggcgcagtggctcacatctataatcccagcactttgggaggccgaggcgggtggatcatctgaggtccggagttcgagaccagcctggccaacatggtgaaaccccgtctctgctaaaaatacaaaattagcctggtgtggtggcgggtgcctataatcccacctactcgggaggctgagggaggagaattgcgtgaacccaggaagcggaagttgcagtgagctgagattgtgccactgcactccagcctgggtgacaagagtgagactctgtctcaaaaaaaaaaaaaaagttgtgtgtcacatggggggactcgggtgcttagcacactgcttgactggggacccagggattaaggccttgacttccgctttcatccaagcctgccattgaccttacatgcagctgctgtgtgtgaggcgctgtggcatgagggaaggtgcgcccaatctgccttgttccttccgtcccaagagacttggaaagccatgagtgtgttctgaccgcatctgtttctgtaacaggatcttcagctgcggcaggcagttgggaaggtcaggacgaggggaagggaaggcaggcctgtggcacctgccatctgcgcccttcactggagtgggcaggccttgcccacatccctgcctgaggcctggggtctggaggcctggctccttgttggctatgtaagcctagcccgccccctggagctggccatcctgcagcatgtggccacggtacccactggctgaatggtggtgcctccctgccgggaagggcagagaagagcccctctcacccaggaaactgcaggactcacggcctctcagcaggcctgaggagggcacgggggtctgagagggaaggaccggccatcccagcctcccctgagcaggctaactttccaggacgcattgcgggctcccttccctccagcccgtggttctctggggagaagggaagggtggacgttgtcttcatttcccagagtgagtcggtgcattcgttcattcatagactcacagcgacagacaccacagtgacgtccctagactcagggagcccttggtctaggacagaaaacgagcaagtagatccttagagattgggacgtgtccagtgaggaggcagagtgttgtctgggtgtggtgtgggggatggggatgggggtgctgctacagaaaggggtcaggagaggcttctcagaggaggtgactttttttttttttttttttgagacagagtttcgctctttttgcccaggctggagtgcagtggcacgatcttggctcactgcagcctccatctcccagctcaagcgattctcctgtctcagcctcccaagtatctgggactacaggcacgtgtcaccacacccggctaatttttgtatttttagtagagatggggtttcaccatattggtcaggctggtctcgaactcctgacctcaagtgatgcacccgcctcagcctcccaaagtgctgggattacaggtgtgagccattgcgcctggccaggaggtgactttcgagttgagatctgaatggcaagtcagctgcggcttaagctgcaggaggggagggaagctgtcagagggagggaagagcagttgcagacccggaggcgggaacaaaccacaaagcctgtagagtggctgaggaggcgtgggcgagccgagggtgagccccggtggagtgctggcatcagggggccttgtcctgggctgaggagttgaggttttactctcagtgcagggacaggtggtgccgagtgaaagcctgtggcagcaaccagcccgctcctgcacggtctcctaagctaattgtgcgcctgctttgggtctgaatggcggggactgcacaggacgtgggttttccttctacggtgggaggtgatctcagggagtctccctgcaggtccccaccaggtcttctgtgtgcctaccatgggcatgcagttctgaagcgctgactggtggtgggaaacctagcctggagattgtcccagccatcccacccaaggcagggacaggccagtggggctacccgagcaaaggcttagggcagctggtagaccgggctgcaagaatgaggccgcagagttagtcttagagtagcacctggcaggaggctggctccgtaagccagtgctcgtccttggcattgttgactcagtggctcagctgatgagcccgaggctgctggggaaggtgtcctcctcagccttacagctccagcccccgcgtgatccgcgtttctcaggcctctgggttactgagaggctgttgggggtggaggtgcccagcggttgttcactgggaagaagaactcaccaccagcgtcccttcatttttcccaaggagtcacaggcagaggtttttccgaacaggctcagcagccagaagtccccgcctgggcttccaactgcctacagaggtagctgcagccctcccctcaggctggcctgtgtcactgccctattctatgtccaggcctcccggcacccagccgctgtccccatgagtgcccaggggagctcccagtttagcagggggagagggttccccagtgcagagtgggtgggaagcccggggcctgtgacctgtgtcacagggcatctgaggatgttgttcctggaaggcaagtgtgtggccacggagctgactttgggctctcatttaggaggctgactctgaaggtcatagtggctcagcagtgaaagaggaggatccccacagtgtgtggtctgtgtggtcactcagggatgtgacctttctgaccctcctcttctttgtcttgggttgggggtcccggccatatccccttcccagggatgtgctaaggtttcagggagctcgggtacataaagggcttgcctgagataactgcgtagtaaatgacagctgtcagtggactccctgccgaacgttgggacaccacagttacggacttgtgccaggagccccagcttcctgccacccctcaccgtgtacctcagagttctcctttgacaaccctccatctggctgtcctgtccctcaggggtgggcatgaggcccaagttccttccttcctttagcccacgttcactgagcacctgctggccgggccccagggagccacccaggtggctgcctccacagccgggctgggctttataactaattctgtcgtgagagactggccttggtgccagacctccctcccggcccacctgccgcctctgggttccttgtgggccaccgcctctgagcagctgctgcttttttttttttctcatttaactttttgttttgttttttggtttttgagacggagtctcattctctgtcactcatgctggagtgcagtggtgtgatctcactcactgcagcttccacctcctgggttcaagcgattctcctgccccagcctcccgagtagctgggattacaggcacgtgccacaacacccgtctaatttttttttttttttgagacagagtcttgctctctgtcacccaggctggagtgcagtgacacgatctcagctcactgcagcctctgcttcccaggttcaagcgattctcctgcctcagcctcctgagtagctgggattacaggcatgtgtcaccatacctggctaatttttgtattttgtagagatggggttttgccctgttggcccgactggtgtcgaactcctgacctcaggtgatctgcccaccttggcctcccaaagtgctgggatcacaggcatgagccacggtgcctggcccgtttaactgtgttttgatggacattttcagacacaagaaagtaggagtataatgagtctgatggaccgacccactttctggcttcagaattgatgactacatggccaatctgttcctgcctatctccatgccactctcacctgcattattttgcagcagctctaagatagctatcattttacctatacattgcttgtgaaacagtgggaacactcagccccaagccggcaccctctgtcctccactgtcatctgccccaggcccaggatcagaccactgggaaagtggccaggtagggctgtgtctcttgtggctctgcacacatgagaggtggtgggtgtggtgctcagagaagagccagctccaccccccagcaccccgcacaaccttgctgtttgaaggaggccgccgccccaggaggggctttaggggctgccaggaagcccggagaagggcctggggtccctctttgttcctggttcccggctgcttcactggctactccatctctgtgttcatttgcttttaaatgaggagcacagattttttattttccccttctttttttttttttttttttttgagatggagtctcactctgtcgcccaggctggagtgcagtggcgcgatctccgctcactgcaagctcctcctcccaggttcacgccattctcctgcctcagcctcccaagtagctgggactacaggtgcccgccaccacgcctgactaatgttttgtatttttagtagagacaaggtttcactgtgttagccaggatggtctcgatctcctgaccttgtgatccgcccaccttagcctcccaaagtgctgggattagaggcgtgagccaccgcacccggctttccccacttcttgcataaagggtagcattcatgagcataccgttctgcaccttgcttttttcatttgtgtcttgaaacctgttccctgttggctaagagagcgcacactcattctctgtggcggcagggctccactgcgtggatgaactctggggagctagccggtccctgctggtggatattgtggttggttccggttctgcattcacaagctgctgcagtgactgtccttacatgtatgatttttcatctttgcaagtatgtctgtaggattaatctccaggtgtgtaattgctaatcaaagggtatatgcatgttacttttttttgagatggagtcttgctctgttgcccaggctggagtgcagtggcgctgtctcattgcaacatccgcctcccaggttcaagcgattctcctcccaagtagctgggattataggcacccgctaccacacctggctaatttttgtatttttagtagagacgggggtttcaccatgttggccaggctggtctccaactcctgacctcaggtgatccacctgcctcagccttggcctctcaaagtgttgggattacaggcgtgacccactgtgccccgcacatttgtacttttgactggtcttgccaaattgcctttgagacggaaccatgtccttggtcaggtcctttctcatctctaagcgtcccctggaaagttggggagataatttctatttctcagggccattaggaagtggaaacgagatcgagtttgtcaatcgcttagttttgggagtgggcgcaaagttacggctccaccggtaaagcacagtagaagggccccaagcagtgtttgttctcttcccccatgcctctctgctgagtgccactggggattgtaggagtggtgggagagcgtggggatgattactgttgggaaatgcatggcagtggctggaagagggggtcagaagcacagacctgcatttacactcacactctgggatgagggactttcctcctcagggcgtctgtctccctgccatgggaggcagtgcatgtgtcagccatggccctcggctgtaagcccagaaacagacccctgcagaatttgtagcaagggaatgtgtggggaggatgtcaccaggcaggaggacagctgggccctcgcatgggcgggattgaggccactggattccctaggtagggagctccccaaatacaggaagaaggttagaggcaggaagagccttttctacccaggaaacctgaccagtgccacgcagtgaatatacagggtcctcacgcaaggacctgagagatgtgtgggcagctgtgtgcagtgtatacagggagtccaggggctggtgtgagccctgctcttgaggggcctctggatgcccgcggtggggtgctggggcctccacgggcgtcattctgtggttgctccaggattggacttagaaatctgggtttgactacatatcaggctgccctggggcccctttcagtaaagatactcccctgagaaatacctgcccttgggaagcccactgcattgggcttacatgactgatcagactctgattctgtgtggagcagcctggggaagggcttggaggcgggagtgaggatggtctccacgtgggcagtgtagacgtgtggttttgcagggatagagacgtgcagcagcacatccgcagaggtagcgaggccttgggggtgtggggttcccacagaaagctctgtgggtactcttctgcctcctcctccctatttcaggccccaggaggccttgtgtggttctgtccctcccctgccccccaactgaggccgtggcattgtgggagcagaggacggaactggacacctagtgaaggtgcgtagaaggcatttgccccaggctggctctgggctgagcacacccattggtgacctcatcacgtgcacaccttcgctgcctgagtgcagggcacccaaaagcctgccatagacaagaagggaccttccctgagttcacccagctggccctgtctgagttggggactcacacctgtgctgactccagagacccaccccagccccaccttcctgttccttcagtcaacacatatttattgagcacttactgtgtgcccagtaaagacccttctggggatatttcagtgaacaaaaggggtaagagttctcccctcattatagcataaatgcacagatcagtacgcttcctgctgggtcatgagaagtgccacctagagaaggaagcagggattcatagtgataaaggggctgactttttggagggtggccagggaaggcctttgaggaggtgacttgggagtgaagacctgcaggcagggagggaaggagccgttggggtgtgaggaagaggggtgctctgggcagggggtaacaggtgcaaagaccctgaggcactgtgtccagatggctctgccactggcaaggatcaggacctcaatgactgtagcagcccctccccagcacccccaagtgaggtctggccatgcagctctcccatgtgcatgctttgcctcccgtgctccataagcaggaccttgacccctccagcctccttgctgacccctctcgtctcacactccaggtcccgatctgtgcagctcactgccagatgcatcaggcagcctcctgcacctgcactttcttcacaaagttccctctgccagagacgccttttgcatctttgtcatctctgagacttttccagatgcctcccgctgcagctgatcccagcctggccatcctccccgcctccatgtcccctccctccctccctccatcatagccttgatgctgttctgccactgcccctggatttgtctcactgattgtgcagaaggctctgggacagagctggcttgtgggggattgggccactgcctattggaggcatttgggggctgtcccaggggtgagtgcaccccaggctggaccaggtgcccacacctctcccgcccagcactggcacctgtgaagggcctctggaggctgggtcttcctgcaggcaccaggaagaaacctacgagcgcatccttgctgagggcaggacccgctctccacatcctggaaacccaacagagaaagacagtctctctggcagcctccctgtcttgaagttcgagaaggctgcatttctaggctcccacaacctgtctgtccggtttgaagccggggcctgagggcttcagggtactgatgcaggacagacagctctggttcaaacctccctctgtccgctcccacaggtgtggcctcagaagaccattccctctgtagcgtggtagaggctggaaattctactctgcaggattatgatgcggattaaatgcagtaatcgagtgtttggcagagtgcctggtagggaaggggttcagtaaagagctgctcgcaccattctgtgcagggaatgctttagggcatgttttagaattttagaacgtgtttcactacatgagtagcttcttgcagctttgaggccctggcatccctctcccctgcctgcaggcttccttgttcactgggccaagtccccgcagtaatcttcctaagcatggagtagaccgggcccttcctggccagaacatccccatctaccttcagggtctactgcagtggccagatgtgagcttctcctctgtccgctcactcaccttctctgtgcctgtcttggccccttctctgtgcctggctggccccatgtggagcaatgttggggtaacagtgtggaccacagaccaccccatgctgtcttcctaggactcatagtccagtgggggagacacacaggtctccagatggtgacaactcagaggggacagggctgagacggggagcccagagggtggggcctgacctaccgtggggatcagggagggcttcctggagaaggcatccctaagctgagaattgaagaagtagtaagcagtgagagcatgtaccgtgtaatgtgtaaaggggagggagaatgtgaggtgctgggaagcaccgggcccttcgggggacgggaagaatttgggtgtggccagagcacagtgccccatgagtggagaggtccagattgtctatttttcttttcttttttttcccccaatgatcctagaaattctcccaagagaggtccagattttttgacaaggctgaagggcggcccctgagacctgactctacctgtctgcctggcctttcctcagtccagtgcgtgcacggccccctcctcgctctcacgcatcatctgtgtgctccttccctgccagacaagaacccctggagggcagggaccagttcagagccatccctgtctccccagtgccagcacagagcttggcctgagtaggttttggggactgggcttggtggctcacacctgtaatcccaacattttgggaggctggggcaggaggatcacctgagcccaggagttcaagaccaacctgtacaacatactgagacccggtctctacataaaaaaagaaaaaaaaaaaaaactggccaagcatggtagggtgtgcctgtagtctcagctacttgggaggttgaggtgggagggtcacttgagcccaggagtgcaaggctgcagtgagctatgattgagccgctgaactccagcctgggtgacagatggggaccccccaaaaaataggttttgggaaatgtttaccagatgagaggcaagacggaattctcctaaattcgaagcttggaattctcctaaattcgaagcctgaggcagaatggttgaagcaaaaagaggagatttgttgtcttatgggtctgaagggtcctgaatagtgtggtgtcaggcacagtatctctttatcaaacaatatctctttaatctctgagcttggccgggcacagtggctcacgtctgtaatcccagcactttgggaggccgaggcgggcggatcattaggtcaagagctggagaccatcctggccaacatggtgaaaccccgtctctactaaaaatacaaaaattagccgggtgtggtggcgcgtgcctgtagtcccagctactcaggaggctgaggcaggagaattgcttgaacctgggaggcagaggttgcagtgagccaagatcacaccactgcactccagcctggcgacagcgagactccatctaaaaaataaaatatctgagcttggctttcctctgagctggcttcattcgcggaaggctgttccctcctgatgggtgcagggatggctgccagtagctctagaaatgggatgcagtcttaaccaccctagtgggaagagagctcctctttcctgagagttccatctcagggcgtaggaccggctgtggctggctctgtaaccttcctgtccctgaccgatcattgtaacagaggttgtgggacggggcacctatccactcctagaacctttggggaggacagcggggagtcaaggtaaagtgaagaggcctatccaggctcctggggtgagagagattgggtgaccaaggctggtccacccaggggaagacaggaagagaagtgggccattctggcctcagacctcttcgtcctttcccagaccccacgccaaggcagagctccctgtgggatgagtttctcacttgacctgaaatctctacttgtggggctgctgcaagtgcacaggcttcaggaaaggtggaccacaccccctgtgccccaggctccttcccgagggtgtgcagcccaccatccagataggggtggatggtgcccaagtcgtgggggctgacaagcatggagagtcctgcagagaggcccagcaccggattcccaggctgctccttgagacgctgtcccacatgggccggtcactcacctgccatgagactcccaactgggaccttccctgcagagcctgtgaggtggaacgatggtgatggtgcccccttgtggggtaggtgcatgtggcaggcacagagtggtggcagcaactgtaacatacggttctggagggcagggacaggggcccttcctgtgtgccttgtggtgctgagtgccaggctgggtgagctcaccaagccctccctgggaaggtgctgttgatgcagcagggaggcccagggcagtcactgctctgtgctgttggcgacggagcagggattggaacccaggcgcctggcttcgaggcccgcatgctgtggggaaatggggctctgccatgttggtggttatttattgtcgtgaacaagagctcaggcctggtttccaggtgtgactttattgcaccctcgccctacctccccggcttgagaattctggaaaataccacaataagtgtttcttttctcttttgagattatgtaaataatacttgcctccatgctcttaaaagaaaatgacatctctatttccatgtgttgcggtgtttcctggtttgggaccccaccagctatccagtcacccaggcttgaagccaggttcttcccagcttctctctccaccctgcccatccctgtgcatgtagcagtgaccaggtcctatcgattatctgattatctgccggaagcctcaggaatgggagccttctgagtcagcacatcaccaggagcacggcctgtggccaggctgctcaggggctggtgatgttggtttctttcaccttaatgtgtgagttgtgtagtaatacggtcctatatcacttaatgatgacacattctgagaactgcgtcgttaggtgatttcatggtcatgtgaacatcctagtggacttacacaaacctaggcctggtcaggcctggtggctcacacctgtaatcccagcactgtgggagttctagatgggcggatcacctgaggtcaggagtttgagaccagcctgaccaacctggtgaaaccccatctctattaaaaatacaaaattagcctggcgtggtggcgtgtgcctgtaatctcagctactcggaaggctgaggcaggaggagaatcgtttgaacctgggaggtggaggttgcagtaagctgagatcatgctattacactccagcctgggcaagaagagtaaaactccatctcaaaaaaaaaaaaaaaaaaaaaaaaccctaggtggcatgcctactgcacacctgggctacctggaatagtctagtgctcttgggctccacacctgcacagcatgtggctgtgctgagtaccctcggcaagtgtaacacagtggtaggtatttgtgtatatgaacgtagacaagggacagtaaaaatatagtgggaaatcttatgggaccaccggctgcatatgcagtccatcattgactgaaatggctttatgcggcttatgactagacctgtatgtgcctcagtattcaaaagatgtaaaaaggtggacagagattcaacataaagaaatgatcaatgtttgggccgggcgcggtggctcacgcttgtaatcccagcactgtgggaggccgaggtgggtggatcatgaggtcaggagatagagaccatcctgactaacacagtgaaaccctgtctctactaaaaatacaaaaattagccaggtgtggtggcacatgcctgtagttccatctactagggaggctgaggcaggagaatcccttgaacccgggaggcagaggttgcagtgagccgagatcgtgccactacactccagcctgggcaacagagcgagactccatctcaaaaaaaaaaaaaaaaaaagataaatgtttgaggtgatatgctaattaccctgactcaatccttgtatgcatttatcgaaataccacatgtaccccataaatatgtataataattatgtattaataaaattaaacattttaaaaaatgtatatagagagaaggaagtttctctctccctgtcctcctttggctttgccagctcaccttcctaaaagcagtcacctagtttattgtatgtccttctggaaggatctctgatggagcttagctaatgacaatccacagcagccacagcccaggccagccgacagagtttgtaaataaagttttatttgcacatgtccaggctcatttgtttatatactatctattactcttttcatgctacaaggcagagttgagtagttgctgcagagcctagtctgatcatttaagcaaaatattgtgatgcctgcagctgtgtgtgtttaaagtcaaggcagggtggtagaggcagcggcagcagcaggcccagaggcagcggttgggtttgcagcgagaagacaaggttgagtcagtgtgtttgcgagagctggaatcgaagcctcttaaaatggcagatgatttggacttcgagacaagagatgcaggggcctcggcctccttcccaatgcagtgctcagcattatgtaacactggcttcgtggtgctcaaaggctggccctgtaaggtctttgagatgtctgcttggaagactggcaagcacagccgcgtcaaggtccacctggttggtattgacatctttactgggaagaaatataaaaataactgcctgtcaccttataatgtgggtgtccccagcatcaaaaggaatgactcccagttgattggcatccaggaaggtacccctcactgctccaggacagcagggaggtgcgagaggaccttcttcgtctgccagaggagaccttggcaaggagatgagcaaaagtaccgctgtggagaagggaccctgatcaccgtgctgtctgccatgacagaggaggcagctgttgcagtcaaggccatggcaaaagaactggctcccagggtgacagtggtggcagcagtgatcttctgagactgcagaggccccctcctctggccttctgtaggctggactcttcctacacaatgtatttgatgttttattttgtttttcccaccccttcaatctgtcggggagcccctgcccttcacctagctcccttggccaggaacaagcaaagccatggccttggtgaagctgccatccttttccctgctcgcactacagccctggttggggggagacggtgggcgatgcttgtggtttatttatttgagacagagtctcactctgttgcccaagctggagtgcacggggcaccatctcggcttactgcaacctccacctcttgggttaagcagttctcctgcctcagcctcccgagtagctgggattacaggcacgtgccaccatgccaggctaatttttgtatttttagtagagacagggtttcactatgttggccaggctggtcttgaactcctgacctcgtgatctgcccgtctcggcctcccaaagtgctgggattacaggtgtgagccactgagcccggccttatttatttattttaattcaatctggaatcagaaagcggtggattctggcacatggtccttgtgccctccccactcacccctggtctggtcccctgttccccatggtcctataccctaagcacgacccccacagactaaggccagccccctgccgtacctgtgcctctccccaaacccctttagatggggagggaaaaggaggagcggggaggggtcctgcccccatgggctttacccttccctgcggtctctctccccaacacatttgttaaaatcaaacctgaataaaactacaagtttaatatggaaaaaaacaataatagtcgaggcagacctgggccttttagtctgtactcttgcctctgtgagccttgactctgaaaaggggatagtaaaaggatgtctcttggggtggctggggggcttctgtggggtccaggcagcacaggacctaaccagcagggtgccaagcagggggatgcctgggctgcaggcattgactcgcctgtgtcccacaacccctcttggagctggagcactagcgggggctcagctgccaaaacccagggacaggtgaggctgtcaccatccaagatggcaatctggtgtgccattcctgactgccaacctgcacgatcaggtcccctccccgtgagtactacaggggaccccactcctgcagaatacaatcctcccatgagcctgaatccatcctgttgctgctctgcccctcgcccccagtggctccggtctcctgcagaatgagagcgaagtcctcaccagggtccacggggtcaccgtcccacatcatccccagtgctcccctcccggtgtgctttggcgccgagcctgctcccaccgtcacacttaagcctgccccagtggttgctgcctgccacggggtttgcacagggactgcgcagtgggcctcctgaatgaagacccagacctgagcccggtggggcctctgggaacactcctttcaaggccagctcaccctggctcctttctgttcattccaaaataacaaaataacacctgcattgcaaagcgtggttattctgagcctggttgccatcacagtcatatggggacctgttaaaatctgggcccctgggccctagctaggacctcctgactctggtgctctgtgaacctggctcgcagacgtcccgatttcatgtggtggacactggggcatgggaaggtcatttccagccagaggtagcatggttgttacggagcagccctaaatattcctgctccaggcttgtctggacttcctccctccccatccctcctctgagagttgacaccctcccactgtgtcccccagcccgcacagtgttgcttcctggtgttttgactcccacttggatgactgtgtctgtttcccccgccctgctccaggctggcacggatggtgtgagtcatcaccgccccctgatgcccaacctgtccttgcatctcttgggtaccattgcacctgtgtgcaaatgccagacagacatctctctgcctgtcacctgatgcccggcgtcaggtttctctctgtccctttgtgagggccacagccggcgggagtgggaggcaagctctgtttgcccttcatcctctccctggggagctggctgccacctgctgggcgagcggcagagccccatccctgcagcagcaaggccctgcccgccagctgctgcacagcagcatctctccctggagctcatgcctttcaccatcccacccagggctccccacaccctgcctccgccccagcccttcccctcctcaggccagacaagggagccgagagttgagctgtgctgtggtttcaggtcaagacagtcctggggtgtgttccagtcctgccacttccaggctccatcccttgggcaggtgtcttttcttctcccagattgcttccctgataagatggaggtctagttatgccagcatcataggggtgctgagctggccaagtgaaattgtgcatggaaagtacttaggagctgggtgaggcggctcacgcctgtaattccagcactttgggaggctgaggcaggaggattgctggagcctgggagttcaagaccagcctgggcaatatagcaagaccttgacccctttgttttttagaaagtgcttattagcactatgcattacacagagtaagtttctgataccgggaagtggctgccaccatcaccaccaccatcatcacgtttttctccatttgtgtctcctgctgactaagccacactgtgacactggtgccagctacttcatgggtgctctcacgtcccttgttgcctgcgaccccacaggtgtccctttcagggagggaaagaggttgctgtggtcatttaacacagcctcggcaggccagggatggaactcaggtcttcttattccaagccgttacctctgcagatccatccccaacacatgcctgctttgtagaaaatactcacacacccaaacacatgtgttttgaacacacctgtcctcctctctgacagccacttgaattctggtccctgcttaatgggccttcagagccttggacttgagcaaatgcatctgagccctgaccttgagacccacactcacacacgtgcccacccccacatacttgtgtgcacatggtggatttactgcatgctggaaaaacaagaggaatgtaaaagctaaggagcagttacgtattttttcttttcttttttttttaagagagtctcactctattgcccaggctggagtacagcgacacaatcacagctcactgcagcctcaaactcccaggctcaagctatcctcccatctcagcctcccaagtcactgcgaccacaggcatgtgctaatttttgtattttttgtttgttttgtagagacagggtctcactttgttgctcggctggtcttgaactcctggtttcaagtgatcctctcgcctcagcctcccgagtagctgggattacaggcacacactaccacgcctggctaatttttaaatttttggcagagatggtatcaccatgttgcctaggctggtctcgaactcctggcctcaagtgattctcttgcctcagcctcccaagtagctgggactacaggcacgcaccaccatgcccaactgattttttagttttttgtagagacaaggtctccctatgttgcccaggctggtctcgaattcctgggctcaaaggaacttcctgccttggcttcccaaagtgctgggattgcaggcatgagccactacccctggaccaagtgagcatgtatatgtgtgtgctaagcactggttccagggagggaccctactaactcactcactcgccacacgaccctgggagttagttacactcatccccattttagggataaaacagttgaggcacgggtcacattgctttgctcaagagtttgagttgggcgctaggatttgactccaggcagtctcgccccagaactcatgttctttttgtgtgtccgtgagaaggagtttcactcttgttgcccaggctggagtgcagtggtgcgatctcagctcaccacaacctccacctccacctcccgggttcaagtgattctcctgcctcagcctcctgagtagctggggttacaggcatgcgccacaacacccagctaatttttgtatttttagtagagacggggtttcaccatgttggccaggcttgtctcgaactcctggcctcagatgatctgccctcctcagcctcccaaagtgctgggattacaggcgtgagccaccgcgcccggcccagaattcacgttcttaaccatattgcaagactctatatctcaggtgggacctgtgagatgctgtgaagcccacctaaggtcactgagtgtgtgagagagacagcaaagatcccagccccatccctcagggccacagctgtgccctaaccactgcgcagcccttccctttggaacctggctctgagctccagcccaggccctacaccaaagcctttgaatgaactacagtcctgccatggctgtttggccttgcctgtggaataggggtcctgtggctatgctcccctggatcctggggacccacccctttatgagacttcagtcactctgcctggaagccgtgactgacaaagatcacctgcttcctgctgccttaaaggagacactgggcatcacatgaccttttccatgtccatcatggggtcatgtgggctgtgacatggcagagtcagatgggtccaagctggccctgtggtcagacgtggtggacccatcacctcccctcgtgagtccgcattgagtgcagatactgaggaactgggtgtgaaatgcctcgggtagcatctctcatgtggttagtgctcagtacgccagagtcagttattttgacccacgcctgctcatgaactgtttcacgctgccattttcttcttagccacctcctcacaccattttaaatggacaggtgtgtgtaggggcccatcctgggccagccagctgctctccctgcaactttggacaagttatcgcacctctgccccatgccgcagttttctcctctcttttttttttctgaaattttttttgtagagactggctttgttggcaaggctggtctcaaactcttggcctaaagcaatcctcctgtcttggcctcacatagtgctgggattgcaggcgtgagccatgtgcccagtctcctctctaaagtgggaggatactaatactcccgtgatggaagtgatcagggaattgaagctgtgtttatttgcattggaagtgctggggatgggcctggcgggtgtgagtgctgtcagcgcgaacttcctctctgatctgcccatgctgctctttcttttttcttattaatagattggtttcttttttatttgaatacatttggcctcatttctaagcaatagtatttgtaaaatcttagttttggtgtgctcattccttttttttttttttcttgagacagagtcactctgtctcccaggctggagtacagtggcacgatctcggctcactgcatccttcacttcccaggctcaactacttgagagtgcctcagcctcctgagtacgtggaactacaggaacccaccaccacgcccggctaatttttgtatttttagtagaagtgcatttctacggcgcttctgtaagcacttgggcggatgtgacctcctcggtctctgactctggtggtgactcctgcaaggccggacctggttccagaccctgtaggtgcccagctgaaggtgtggtctgattgctgtgtggggagtgaaggttgccagcctagaaactgggcctcaagctcactcagaggctcttggaacaaagaagaggcaccatcttggctgggcacggtggctcacgcctgtaatcccagcactttgggaggccgaggtgggcagatcatgcggtcaggagttcgagaccagcctgaccaacgtggtgaaaccccatctctactaaaaatgcaaaaattagccaggtgtggtggcgtgtgcctgtaattccagcaactcgggaggctgaggcaggagaatcgcttgaaccagggaggtagaggttgcagtgggctgagatcatgccactgaactccagcctgggcgacagagtgaaactctgtctcaaaaaaaaagaagaggtgccatcccaatgcatgagaccggctgccattgtgtcaggggttatggtggtatccaccctgatgccacagccagctctgggccagcctcctcgccccagcggtgcccacccccagcttgatcctggaccctggcaatggtgtgacatgagctgctgctaagcgtttgcagtgctaggcccgggccggactttctccacaaacgatttagttccgttagttcacccaccctgtaaaacagctacgcttctcttccccgtttaaagctt

SEQ ID NO: 37 - DNA, 4276 bp, Homo sapiens
ccacgcgtccgccgcgccgcccgcagccccctcccggccctgcagcccctgggcgggcggcgcccctcggaggacggctccgggcccggggggacggagggcctggtcgcctggaggaagccggaggcctgcgtggaggaggcgccccgcgcagctggctggcggagcatgagcgccccagatcccaagcactgcaagtccagatgcaacgggagcctggctcaagggacgacaagatccagccggaaagtgtagaagtcacaccccaatggcgggatagcagcccctgtgtgtgagcacccctccatgccaggaggagggccagagatggatgactacatggagacgctgaaggatgaagaggacgccttgtgggagaatgtggagtgtaaccggcacatgctcagccgctatatcaaccctgccaagctcacgccctacctgcgtcagtgtaaggtcattgatgagcaggatgaagatgaagtgcttaatgcccctatgctgccatccaagatcaaccgagcaggccggctgttggacattctacataccaaggggcaaaggggctatgtggtcttcttggagagcctagaattttattacccagaactgtacaaactggtgactgggaaagagcccactcggagattctccaccattgtggtggaggaaggccacgagggcctcacgcacttcctgatgaacgaggtcatcaagctgcagcagcagatgaaggccaaggacctgcaacgctgcgagctgctggccaggttgcggcagctggaggatgagaagaagcagatgacgctgacgcgcgtggagctgctaaccttccaggagcggtactacaagatgaaggaagagcgggacagctacaatgacgagctggtcaaggtgaaggacgacaactacaacttagccatgcgctacgcacagctcagtgaggagaagaacatggcggtcatgaggagccgagacctccaactcgagatcgatcagctaaagcaccggttgaataagatggaggaggaatgtaagctggagagaaatcagtctctaaaactgaagaatgacattgaaaatcggcccaagaaggagcaggttctggaactggagcgggagaatgaaatgctgaagaccaaaaaccaggagctgcagtccatcatccaggccgggaagcgcagcctgccagactcagacaaggccatcctggacatcttggaacacgaccgcaaggaggccctggaggacaggcaggagctggtcaacaggatctacaacctgcaggaggaggcccgccaggcagaggagctgcgagacaagtacctggaggagaaggaggacctggagctcaagtgctcgaccctgggaaaggactgtgaaatgtacaagcaccgcatgaacacggtcatgctgcagctggaggaggtggagcgggagcgggaccaggccttccactcccgagatgaagctcagacacagtactcgcagtgcttaatcgaaaaggacaagtacaggaagcagatccgcgagctggaggagaagaacgacgagatgaggatcgagatggtgcggcgggaggcctgcatcgtcaacctggagagcaagctgcggcgcctctccaaggacagcaacaacctggaccagagtctgcccaggaacctgccagtaaccatcatctctcaggactttggggatgccagccccaggaccaatggtcaagaagctgacgattcttccacctcggaggagtcacctgaagacagcaagtacttcctgccctaccatccgccccagcgcaggatgaacctgaagggcatccagctgcagagagccaaatcccccatcagcctgaagcgaacatcagattttcaagccaaggggcacgaggaagaaggcacggacgccagccctagctcctgcggatctctgcccatcaccaactccttcaccaagatgcagcccccccggagccgcagcagcatcatgtcaatcaccgccgagcccccgggaaacgactccatcgtcagacgctacaaggaggacgcgccccatcgcagcacagtcgaagaagacaatgacagcggcgggtttgacgccttagatctggatgatgacagtcacgaacgctactccttcggaccctcctccatccactcctcctcctcctcccaccaatccgagggcctggatgcctacgacctggagcaggtcaacctcatgttcaggaagttctctctggaaagacccttccggccttcggtcacctctgtggggcacgtgcggggcccagggccctcggtgcagcacacgacgctgaatggcgacagcctcacctcccagctcaccctgctggggggcaacgcgcgagggagcttcgtgcactcggtcaagcctggctctctggccgagaaagccggcctccgtgagggccaccagctgctgctgctagaaggctgcatccgaggcgagaggcagagtgtcccgttggacacatgcaccaaagaggaagcccactggaccatccagaggtgcagcggccccgtcacgctgcactacaaggtcaaccacgaagggtaccggaagctggtgaaggacatggaggacggcctgatcacatcgggggactcgttctacatccggctgaacctgaacatctccagccagctggacgcctgcaccatgtccctgaagtgtgacgatgttgtgcacgtccgtgacaccatgtaccaggacaggcacgagtggctgtgcgcgcgggtcgaccctttcacagaccatgacctggatatgggcaccatacccagctacagccgagcccagcagctcctcctggtgaaactgcagcgcctgatgcaccgaggcagccgggaggaggtagacggcacccaccacaccctgcgggcactccggaacaccctgcagccggaagaagcgctttcaacaagcgacccccgggtcagcccccgtctctcgcgagcaagcttcctttttggccagctccttcagttcgtcagcaggtccgagaacaagtataagcggatgaacagcaacgagcgggtccgcatcatctcggggagtccgctagggagcctggcccggtcctcgctggacgccaccaagctcttgactgagaagcaggaagagctggaccctgagagcgagctgggcaagaacctcagcctcatcccctacagcctggtacgcgccttctactgcgagcgccgccggcccgtgctcttcacacccaccgtgctggccaagacgctggtgcagaggctgctcaactcgggaggtgccatggagttcaccatctgcaagtcagatatcgtcacaagagatgagttcctcagaaggcagaagacggagaccatcatctactcccgagagaagaaccccaacgcgttcgaatgcatcgcccctgccaacattgaagctgtggccgccaagaacaagcactgcctgctggaggctgggatcggctgcacaagagacttgatcaagtccaacatctaccccatcgtgctcttcatccgggtgtgtgagaagaacatcaagaggttcagaaagctgctgccccggcctgagacggaggaggagttcctgcgcgtgtgccggctgaaggagaaggagctggaggccctgccgtgcctgtacgccacggtggaacctgacatgtggggcagcgtagaggagctgctccgcgttgtcaaggacaagatcggcgaggagcagcgcaagaccatctgggtggacgaggaccagctgtgaggcgggcgccctgggcagagagactctgtggcgcggggcatcctatgaggcaggcaccctgggcagagagatgcagtgggtgcggggggatcctgtggcccacagagctgccccagcagacgctccgccccacccggtgatggagccccggggggacagtcgtgcctggggaggagcagggtacagcccattcccccagccctggctgacctggcctagcagtttggccctgctggccttagcagggagacaggggagcaaagaacgccaagccggaggcccgaggccagccggcctctcgagagccagagcagcagttgaatgtaatgctggggacaggcatgctgccgccagtagggcggggacccggacagccaggtgactaccagtcctggggacacactcaccataaacacatccccaggcaggacagatcggggaaggggtgtgtaccaggctatgatttctcttgcattaaaatgtattattaaaaaaaaaaaaaaaa

SEQ ID NO: 38 - DNA, 3166 bp, Homo sapiens
ggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 39 - DNA, 1579 bp, Homo sapiens
agcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaacaacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctatacagacaccaccattaaagcattttcatagtgaaaaaaaaaaaaaaaa

SEQ ID NO: 40 - DNA, 1580 bp, Homo sapiens
atcccctccggttttcctcagtctccacgtacgtccctcaaagcgcgtcctaaaacccggataaccggagcgctccccatggaccacacggagggcttgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcattttttctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatgtctacatccattatggacaaacatgcaaacttgtgtgctcagttactggcatggcactcccaagattgataattatgaaagttgataagcataccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccacggccacattgcagtgtagcaggagcaatccttccagccaattcaagccaggtgccccctaacgaatcaaacacaaacagcgagggaagttacacaaacgccagcacaaattcaaccagtgtcacatcatctacagccacagtggtatccta

SEQ ID NO: 41 - DNA, 2347 bp, Homo sapiens
gcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacaccgctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcggtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagacctgcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacaaggagtttccagctgctggctggagtctcaggccaaattgcagagggtcctccagggtcctgaagagcactggactaagagtctagtggttccagggccctgaccagtaggtgctcaataaatgtttgttgttgaatgaaaaaaaaaaaaaaaaaa

SEQ ID NO: 42 - DNA, 1755 bp, Homo sapiens
agagagaagcgaggtttccattctgagggacggcgtagagttcggccgaaggaacctgacccaggctctgtgaggaggcaaggttttcaggggacaggccaacccagaggacaggattccctggaggccacagaggagcaccaaggagaagatctgcctgtgggtcttcattgcccagctcctgcccacactcctgcctgctgccctgacgagagtcatcatgtctcttgagcagaggagtctgcactgcaagcctgaggaagcccttgaggcccaacaagaggccctgggcctggtgtgtgtgcaggctgccacctcctcctcctctcctctggtcctgggcaccctggaggaggtgcccactgctgggtcaacagatcctccccagagtcctcagggagcctccgcctttcccactaccatcaacttcactcgacagaggcaacccagtgagggttccagcagccgtgaagaggaggggccaagcacctcttgtatcctggagtccttgttccgagcagtaatcactaagaaggtggctgatttggttggttttctgctcctcaaatatcgagccagggagccagtcacaaaggcagaaatgctggagagtgtcatcaaaaattacaagcactgttttcctgagatcttcggcaaagcctctgagtccttgcagctggtctttggcattgacgtgaaggaagcagaccccaccggccactcctatgtccttgtcacctgcctaggtctctcctatgatggcctgctgggtgataatcagatcatgcccaagacaggcttcctgataattgtcctggtcatgattgcaatggagggcggccatgctcctgaggaggaaatctgggaggagctgagtgtgatggaggtgtatgatgggagggagcacagtgcctatggggagcccaggaagctgctcacccaagatttggtgcaggaaaagtacctggagtaccggcaggtgccggacagtgatcccgcacgctatgagttcctgtggggtccaagggccctcgctgaaaccagctatgtgaaagtccttgagtatgtgatcaaggtcagtgcaagagttcgctttttcttcccatccctgcgtgaagcagctttgagagaggaggaagagggagtctgagcatgagttgcagccaaggccagtgggagggggactgggccagtgcaccttccagggccgcgtccagcagcttcccctgcctcgtgtgacatgaggcccattcttcactctgaagagagcggtcagtgttctcagtagtaggtttctgttctattgggtgacttggagatttatctttgttctcttttggaattgttcaaatgtttttttttaagggatggttgaatgaacttcagcatccaagtttatgaatgacagcagtcacacagttctgtgtatatagtttaagggtaagagtcttgtgttttattcagattgggaaatccattctattttgtgaattgggataataacagcagtggaataagtacttagaaatgtgaaaaatgagcagtaaaatagatgagataaagaactaaagaaattaagagatagtcaattcttgccttatacctcagtctattctgtaaaatttttaaagatatatgcatacctggatttccttggcttctttgagaatgtaagagaaattaaatctgaataaagaattcttcctgttaaaaaaaaaaaaaaaaaaaaaaaaaaaaaaaaaaaaaaaaaaaaaa

SEQ ID NO: 43 - DNA, 1282 bp, Homo sapiens
ctcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcagagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcctgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttcaaaaaaaaaaaaaaaaaaaa

SEQ ID NO: 44 - DNA, 755 bp, Homo sapiens
ctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgaaaaaaaaaaa

SEQ ID NO: 45 - DNA, 498 bp, Homo sapiens
ggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctattttggaaatttgttcattaaaattctcccaataaagctttacagccttctgcaaa

SEQ ID NO: 46 - DNA, 576 bp, Homo sapiens
atgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcg

SEQ ID NO: 47 - DNA, 2336 bp, Homo sapiens
ggcaagattctgaggggaagtgtagctcccaggttggttccaagtcttcttccaattaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgtaaaaaaaaaaaaaaaa

SEQ ID NO: 48 - DNA, 1375 bp, Homo sapiens
gcagctcctcaacgccgcaacgcgccggcccaactgcaggaaggtctgtgctctggagccaggggttataaaattatacaccatggccctcctaaagacactctaggaaaaccatgtcatcctgatcttaaaacacctgcaagaaagagcacagtacttcaccattaataaagtagatatttcatcctgctcagaaaaccaacatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgcaaaaaaaaaaaaaaaa

SEQ ID NO: 49 - DNA, 529 bp, Homo sapiens
gaaggagggccgaggagtggaggggctcaggcgaagctggggtgctgttgggggtatccgagtcccagaagcacctggaaccccgacagaagattctggactccccagacgggaccaggagagggacggcatgagcgacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaaaaaaaaa

SEQ ID NO: 50 - DNA, 984 bp, Homo sapiens
ggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgagaggaggcgccccgcggggtccgcatggcggtgccgcttctgcgcaggatggaaggtgcccctgcggggccaggaggccggacagccgcctgcttgagttgcacatcacgatgcctttctcgtcgcccatggaagcggagctggtccgcaggatcctgtcccgggatgccgcaccgctcccccgaccaggggcggttctgaaggacttcaccgtgtccggcaacctactgtttatgtcagttcgggaccaggacagggaaggcgctgggcggatgagggtggtgggttgggggctgggatccgcctccccggaggggcagaaagctagagatctcagaacacccaaacacaaggtctcagaacagagacctggtacaccaggcccgccgccacccgagggagcccagggagatgggtgcagaggtgtcgcctttaatgtgatgttctctgcccctcacatttagccgactgactgctgcagaccaccgccaactgcagctctccatcagctcctgtctccagcagctttccctgttgatgtggatcacgcagtgctttctgcccgtgtttttggctcaggctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaagctgagctacgaaaaaaaaaaaaaaaaaaaaaaaaaaaaaaaaaaaaaaaaaaa

SEQ ID NO: 51 - DNA, 467 bp, Homo sapiens
cttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctcaaaaaaaaaaaaaaaaaaaaaaaaaaaaa

SEQ ID NO: 52 - DNA, 2569 bp, Homo sapiens
ggtgctgaggacggacgccattggagttcccgagaaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaaaaaaaaaaaaaaaaaaaaaaaaaaaaaaaaaaaaaaaaaaaaaaaaaaaaaaaaaaaaaaaaa

SEQ ID NO: 53 - DNA, 435 bp, Homo sapiens
gggggcgaagattcaaaacctacaaaagcctgccgcagacattgaagaaccaatatatacaatggacaaacaatccagtgccggcggggtgaagaggagcgtcccctgtgaatccaacgaggtgaatgagacgatgccggagaccccaactggggactcagacccgcaacctgctcctaaaaaaatgaaaacatctgagtcctcgaccatactagtggttcgctacaggaggaacgtgaaaagaacatctccagaggaactgctgaatgaccacgcccgagagaacagaatcaaccccctccaaatggaggaggaggaattcatggaaataatggttgaaatacctgcaaagtagcaagaagctacatctctcaaccttgggcaatgaaaataaagtttgagaagccgaaaaaaaaaaaaaaaaaaaaaaaaaaa

SEQ ID NO: 54 - DNA, 2176 bp, Homo sapiens
cggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgatggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaaaaaaaaaaaaaaaaaaaaaaaaaaaaaaaaaaaaaaaaaaaaaaaaaaaaa

SEQ ID NO: 55 - DNA, 1324 bp, Homo sapiens
gcagtcggctgccaccccgggatgggtcgctggtgccagaccgtcgcgcgcgggcagcgcccccggacgtctgccccctcccgcgccggtgccctgctgctgctgcttctgttgctgaggtctgcaggttgctggggcgcaggggaagccccgggggcgctgtccactgctgatcccgccgaccagagcgtccagtgtgtccccaaggccacctgtccttccagccggcctcgccttctctggcagaccccgaccacccagacactgccctcgaccaccatggagacccaattcccagtttctgaaggcaaagtcgacccataccgctcctgtggcttttcctacgagcaggaccccaccctcagggacccagaagccgtggctcggcggtggccctggatggtcagcgtgcgggccaatggcacacacatctgtgccggcaccatcattgcctcccagtgggtgctgactgtggcccactgcctgatctggcgtgatgttatctactcagtgagggtggggagtccgtggattgaccagatgacgcagaccgcctccgatgtcccggtgctccaggtcatcatgcatagcaggtaccgggcccagcggttctggtcctgggtgggccaggccaacgacatcggcctcctcaagctcaagcaggaactcaagtacagcaattacgtgcggcccatctgcctgcctggcacggactatgtgttgaaggaccattcccgctgcactgtgacgggctggggactttccaaggctgacggcatgtggcctcagttccggaccattcaggagaaggaagtcatcatcctgaacaacaaagagtgtgacaatttctaccacaacttcaccaaaatccccactctggttcagatcatcaagtcccagatgatgtgtgcggaggacacccacagggagaagttctgctatgagctaactggagagcccttggtctgctccatggagggcacgtggtacctggtgggattggtgagctggggtgcaggctgccagaagagcgaggccccacccatctacctacaggtctcctcctaccaacactggatctgggactgcctcaacgggcaggccctggccctgccagccccatccaggaccctgctcctggcactcccactgcccctcagcctccttgctgccctctgactctgtgtgccctccctcacttgtgggccccccttgcctccgtgcccaggttgctgtgggtgcagctgtcacagccctgagagtcagggtggagatgaggtgctcaattaaacattactgttttccacgaaaaaaaaaaaaaaaa

SEQ ID NO: 56 - DNA, 1030 bp, Homo sapiens
ggaggcttctgggccacggactgccggaccgttgggctgtgaggcagcgtctcagcgaggcggcacccggagccatgtcttcacataggaggaaagcgaaggggaggaataggagaagtcaccgtgccatgcgtgtggctcacttagagctggcaacttatgagttggcggcaactgagtcgaatcccgagagcagccatcctggatacgaggccgccatggctgacaggcctcagccaggatggcgggaatctctaaagatgcgggtcagcaaaccctttgggatgctcatgctctccatttggatcctgctgttcgtgtgctactacctgtcctactacctgtgctccgggtcctcatattttgtgcttgcaaatggacatatcctgcccaacagtgaaaatgctcatggccaatctctggaagaagattccgcattggaagctttgctgaattttttctttccaacaacttgcaatctgagggaaaatcaggtggcaaagccttgtaatgagctgcaagatcttagtgagagtgaatgtttgagacacaaatgctgtttttcatcatcggggaccacgagcttcaaatgttttgctccatttagagatgtgcctaaacagatgatgcaaatgtttgggcttggtgcgatcagccttatcctggtatgtctgcccatttattgccgctctcttttctggaggagcgaaccggccgatgatttacaaaggcaggacaacagagttgtaacgggtttgaagaaacaaagaaggaagcgaaagaggaagtctgaaatgttacagaaagcagcaagaggacgtgaggaacatggtgacgagtagcaagagaccaaagcattattttcccctcaagacaacagaaaccattcagagcagaggggactgtctcagccatgcaaacctcatggagcattttggaaagttaaaaattgattcttatttttgtcatgtttactttcaaacatgaaataaaattgagttctgttttcatgcaccaaaaaaaaaaaaaa

SEQ ID NO: 57 - DNA, 1084 bp, Homo sapiens
agaggtgattttctgagtgtgactcctctgttcctggcaccctgtgcatccttagccatagcttacaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatggggtcccagctgccaaagcccagaatgctgagagaatcaggccatggggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggcctccgtattggagccatccctgcttccccttctttctttcctctttccccaggccgccactgcccttgcccctttcatctcccagcagccctcaggagcgtcaggatcattttcaactctggttaggcctcctacctggggaggccaggtcactgcactgggaggtcctggctgctgcgaagctggaggaggactgcgtgggctgagatgccaccctttgaagggtgaacagcatggcggcatctgggccccccagtaacacctagtggcaaccttgccttcctgacctcagcggcccttctgttccatcctctgtgggcaggggtgtggctttgttttcctccctcgtttgcttccacctcgtgcacagcgctctgcacagacaacacgctcaataaaagttcagccatagcagcaaaaaaaaaaaaaaaa

SEQ ID NO: 58 - DNA, 754 bp, Homo sapiens
cagagctctgcaaggagaggttgtgtcttcgttctttccgccatcttcgttctttccaacatcttcgttctttctcactgaccgagactcagccggtaggtctgcagagtggtcttcctggtaatttagttgtgagtgaatgtgtggaggagccagcgggcttaggacaggtcctgtggcacagtccgtggctttgagggaaaagggcctcgcggtggtcctccgccttcccccaggtcgtgatgcaggcgccatgggccggtaatcgtggctgggctggaacgagggaggaagtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaaaaaaaaaaaaaaaaaa

SEQ ID NO: 59 - DNA, 1287 bp, Homo sapiens
atccctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatgatatgcctgatgggggagctgaacacattgcaaagaccgtatcatatttaaaggaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggtcaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggttgaagaatatattactcctgaaaaattcaaatactgggaaaaagtaggaaatgaacttggatttcattatactgcaagtggccctttggtgcgttcttcatataaagcaggtgaatttttcctgaaaaatctagtggctaaaagaaaaacaaaagacctctaaaacttcaacaagaccttcaagatcacagaaatttttaaaatttgattccagttaataacagaggtggtgccagaatgcctggactgcagtggatgtaccccacctctttgcttaaaaaaaaaaaaaaaa

SEQ ID NO: 60 - DNA, 699 bp, Homo sapiens
ggttccataggcagttcttaccaagaagatgtcgattccattctccaacacccactaccgaattccacaaggatttgggaatcttcttgaagggctgacacgcgagattctgagagagcaaccggacaatataccagcttttgcagcagcctattttgagagccttctagagaaaagagagaaaaccaactttgatccagcagaatgggggagtaaggtagaagaccgcttctataacaatcatgcattcgaggagcaagaaccacctgagaaaagtgatcctaaacaagaagagtctcagatatctgggaaggaggaagagacatcagtcaccatcttagactcttctgaggaagataaggaaaaagaagaggttgctgctgtcaaaatccaagctgccttccggggacacatagccagagaggaggcaaagaaaatgaaaacaaatagtcttcaaaatgaggaaaaagaggaaaacaagtgaggacactggttttacctccaggaaacatgaaaaataatccaaatccatcaaccttcttattaatgtcatttcttcctgaggaaggaagatttgatgttgtgaaataacattcgttactgttgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 61 - DNA, 721 bp, Homo sapiens
ctggttctgaggggtcggcttgagatcggctgagggaagcgggctcaggatctgtgaggaggcaaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaatatcaattaaggagccggtcacaaggcgaaatgcttgagagtgtcatcacattacagaacccttcctgaatcttcgggaagctcgatgctgcggggactgggttattagagtggccccgggcccaacctttacggggggcccaaaggcgggac

SEQ ID NO: 62 - DNA, 616 bp, Homo sapiens
cggaagtcgtcccaggctgctagatactaaggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaaagacaaccctagtggccacaccta

SEQ ID NO: 63 - DNA, 1626 bp, Homo sapiens
acttccgctttggaggcgaggacccgagcgagtgtagggggtgcggcgtctggtcagccaggggtgaattctcaggactggtcggcagtcaagccatcatgcctcgtggtcagaagagtaagctccgtgcccgtgagaaacgccgcaaggcccgagatgagacccggggtctcaatgttcctcaggtcactgaagcagaggaagaagaggccccctgctgttcctcttctgtttctgggggtgctgcttcaagctctcctgctgctggcattccccagaagcctcagagagccccaaccactgccgctgctgcagctgcgggtgtttcatccacaaaatctaaaaaaggtgccaagagccaccaaggtgagaaaaatgcaagttcctcccaggcctcaacatctactaagagcccaagcgaagatcctctaaccaggaagtcagggtcgttggtgcagttcctgttgtacaagtataaaataaaaaagtccgttacaaagggagaaatgctgaaaattgttggcaaaaggttcagggagcacttccctgagatcctcaagaaagcctctgagggcctcagtgttgtctttggccttgagctgaataaagtcaaccccaacggccacacttacaccttcatcgacaaggtagacctcactgatgaggaatccctgctcagttcctgggactttcccaggagaaagcttctgatgcctctcctgggtgtgatcttcttaaatggcaactcagctactgaggaagagatctgggaattcctgaatatgttgggagtctatgatggagaggagcactcagtctttggggaaccctggaagctcatcaccaaagatctggtgcaggaaaaatatctggagtacaagcaggtgcccagcagtgatcccccacgctttcaattcctgtggggtccgagagcctatgctgaaaccagcaagatgaaagtcctggagtttttggccaaggtaaatggtaccaccccctgtgccttcccaacccattacgaagaagctttgaaagatgaagagaaagccggagtctgagccagagttgtagccaggccttgcactactgccatagccaatcaatctcccaaagccaagtttacctgctgttctcacccccaatgaggtcttaggcagattctttactttgtaattcaaaaggcctgttaacctttgttcttgttatgcatgaataacttgttgactttttttttttctctttttcaactagtgtttcaacaggtttatttagattcagaatgtaaatttacaaatgatatagatcaccctgttattgctgtttttcagggacagtagaaagtgttttgttttttgagtgaaacaacttattaataaaaatccttaaatcacttttgtaatccaggacaagaaaatgtggcattagaatagaaatatctttggaaatgtgaaagaccccatagtgaaatatttgggatcagaagccagaggggtaaaagtggtcaattcttggtttacttcatttaatctttcttttcataaagatacatacctggatttgtttatgttattcaagaatgtgtgagaaattaaaccatagttagttaaaaaagaaaaaaaaaaaaaa

SEQ ID NO: 64 - DNA, 1742 bp, Homo sapiens
gttagagagaagcgagctgctgtctgaccagcagcttgggattggtggaaggaagcaggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgagcagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccaccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaaaaaaaaaaaaaaaaaaaa

SEQ ID NO: 65 - DNA, 1261 bp, Homo sapiens
ccaactgctgccaactcgccaccactgctgccgacctcgcaaccactgctttgtctctgaagtgagactgctcctggtgccatgaacggagacgacacctttgcaaagagacccagggatgatgctaaagcatcagagaagagaagcaaggcctttgatgatattgccacatacttctctaagaaagagtggaaaaagatgaaatactcggagaaaatcagctatgtgtatatgaagagaaactataaggccatgactaaactaggtttcaaagtcaccctcccacctttcatgtgtaataaacaggccacagacttccaggggaatgattttgataatgaccataaccgcaggattcaggttgaacatcctcagatgactttcggcaggctccacagaatcatcccgaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagcgaccctgaggaagatgacgagtaactcccctgggggatacgacacatgcccttgatgagaagcagaacgtggtgacctttcacgaacatgggcatggctgcggctccctcgtcatcaggtgcatagcaagtgaaagcaagtgttcacaacggtgaaacttgagcgtcatttttcttagtgtgccaagagttcgatgttagtgtttccattgtattttcttacagtgtgccattctgttagatactatccttataattgatgagcaagacatactgaatgcatatttcggtttgtgtatccatgcacctacgtcagaaaacaagtattgtcaggtattctctccatagaacagcactatcctcatctctccccagatgtgactactgagggcagttctgagtgtttaatttcagactttttcctctgcatttacacacacacacacacacacacgcacacacacacaccaagtaccagtataagcatctcccatctgcttttcccattgccatgcgtcctggtcaagcccccctcactctgtttcctggtcagcatgtactcccctcatccgattcccctgtatcagtcactgacagttaataaacctttgcaaacgttcaaaaaaaaaaaaaaaaaa

SEQ ID NO: 66 - DNA, 473 bp, Homo sapiens
ctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggacaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgtt

SEQ ID NO: 67 - DNA, 477 bp, Homo sapiens
agctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaagggcaatcacagtgttaaaagaagacatgctgaaatgttgcaggctgctcctatgttggaaatttgt

SEQ ID NO: 68 - DNA, 1715 bp, Homo sapiens
ggggggagggaagccggcccaggctcggtgaggaggcaaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaaggcaggcctcctgataatcgtcctggccataatcgcaagagagggcgactgtgcccctgaggagaaaatctgggaggagctgagtgtgttagaggtgtttgaggggagggaagacagtatcttgggggatcccaagaagctgctcacccaacatttcgtgcaggaaaactacctggagtaccggcaggtccccggcagtgatcctgcatgttatgaattcctgtggggtccaagggccctcgttgaaaccagctatgtgaaagtcctgcaccatatggtaaagatcagtggaggacctcacatttcctacccacccctgcatgagtgggttttgagagagggggaagagtgagtctgagcacgagttgcagccagggccagtgggagggggtctgggccagtgcaccttccggggccgcatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttactcaaattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctctccaaaaaaaaaaaaaaaaaaaaaaaaaaaaaa

SEQ ID NO: 69 - DNA, 683 bp, Homo sapiens
agaccagaccaacagtaacaccaagggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagcatcgctcctgcagaaggcgcaaaagacgctcctgcaggcaccggaggaggcatcgcagaggctgcagaaccaggaagagaacatgcagaaggcactaagcttcctgggcccctcacccccagctggaaattaagaaaaagtcgcccgaaacaccaagtgaggccatagcaattcccctacatcaaatgctcaagcccccagctggaagttaagagaaagtcacctgcccaagaaacaccgagtgaggccatagcaactcccctacatcaaatgctcaagccctgagttgccgccgagaagcccacaagatctgagtgaaacgagcaaaagtcacctgcccaataaagcttgacaagacactc

SEQ ID NO: 70 - DNA, 1799 bp, Homo sapiens
agtcacatagctgcgtggtacgtgactggaggtgtatccttgtcctcgtctgaatcacgctgatgtggccccaaccccacctccctccccaccccatgatgtcagaaaaaaccagacagaacaaattggctgaggccaagaaaaagtttacagactatcgtcagtggaacattgctggtgttggtaccggagcaactgacaccaaaaagaagaaaataaatcatggcactaaccctgagacaaccacttcggggggctgccactcgcctgaggatacacaacagaaccgagcgcagctgaaagaagaaaagaagatgcgggagcaggaagatgtggagacaggaggagaggctgcaggagcaggagaagcagatgtgggagcaggaggagaagatgcgggatcaggagcagaagatgtgggaccaggaggagaggatgtgggagcaggacgagaggctgcggcagaaggaggagagaatgcgggagcagaagatgtggcagcaggtggagaagatgcgggaggagaagaagacgcaggagcaggagaagaagacatgggaccaggagaagatgcgagaggaggagagcatgcgggagcgggagaagaagatgcgggaggaggaggagatgatgcgggagcaggaggagaagatgcaggagcaggaagaaaagatgcaggagcaggaggaggagatgtgggagcaggaggagaagatgtgggagcaggaagagaagatgtgggagcagcagaggctaccggaacagaaggagaggctgtgggaacacgagaagatgcaggagcaggagaagatatgggagcaggaggagaagatgcgggaccaggaggagaagatgcggggccaggaggagaagatgcgggggcaggaggagaagatgcgggggcaggaggagaagatgtgggggcaggaggagaagatgtgggggcaggaggagaagatgtggggccaggaggagaagatgtgggggcaggaggagaagatgtggggccaggaggagaagatgcggggggcaggaggagaagatgcgggggcaggaggagaagatgcggggccaggaggagaagatgcgggggcaggaggaggagatgcggggggcaggaggagaagatgcggggggcaggaggagaagatgcgggggacaggaggagaagatgcgggggccaggaggagaagatgcgggagcaggaggagaagatgcgggagcaggaggagaagatgcagggccaggaggagaagatgcgggagcaggaggagaagatgcggggccaggaggagaagatgcgggagcaggaggagaagatgcggggccaggaggagaagatgtggggccaggaggagaagatgtgggggcaggaggagaagatgtgggggcaggaggagatgatgcgagagaaggaggagaggatatgagatcagaaagagaagatgcaggagaggctgccagagcacgaggagcggtgctcagagccctgcctccctccctccaaagttctttgtaatatgagccacactggcagtgtggagcctgcaggaggagaggctggggagggttctccgcaggacaaccccactgcacaggagatcatgcagctgttttgtgggatgaagaacgcccagcagtgcccaggattaggcagtacctcctgcatcccattcttctaccgaggagacaagagaaagatgaagatcatcaatatctaaaagttggcactgtcaacaaggcctacagaagcataagccgccatgtcactgtgtgaatatagtctgagcacaaacttg

SEQ ID NO: 71 - DNA, 3866 bp, Homo sapiens
gtaaagcgctccgaggcggagccgccgccgcgcggccggggcttttcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtgagggcgggcccgcggcctccctcccgcacactcctgctgcccccggactgcttcagagcgagcagccccacctcatcgcgcttggggacccgggctgccgccagctctgaagcctcggccgccatccctgcccgattatctggagcccctgcccccagcactctttctgcaagtgtcttgctcacagtccttagtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaaaaaaaaaaaaaaaaaaaaaa

SEQ ID NO: 72 - DNA, 890 bp, Homo sapiens
tttcctttctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttc

SEQ ID NO: 73 - DNA, 4416 bp, Homo sapiens
agcttggcgccaagaagctcagcctggctgcgcaggggaagctctttgcttgctcgtcaccgtggcaacgcgcgcggccgtttccggaggcggtggccaaagtgggcggggctaggccggagctgctggtgggaggcagccacttgagatcaccaggcctcctgtagaccggcgggtgcagggcccggtcccagagttaagggaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcagaatactctgaaacatatttcccagtggcccaaactctttattaggaaaatggacgaattgaatagcaaatggagcatttcctccctctgctatttatacacggaaagacttactacagcgatctacccatattgccaccaagactttccaggctcttcgcatatttgtgaacaatgagctcaatgaactctacacgggactgaagacagctcagaagtttctgagacctggtggtcgtcttgttgccctctccttccattcactagaggatcgcatcgtcaaaagatttttgcttggaataagcatgacagaaagatttaacctaagtgttagacaacaagtgatgaaaacatctcaattgggttcagatcacgaaaacacggaagaagtctctatgagaagagctcctttaatgtgggaattgatacacaagaaggtacttagtccacaagatcaggatgtacaagataaccccagagggcgctcagccaagcttagagcagctatcaaattataagttatcatcatcttattcttcaaatttttttctcacaatttctctaatctttactcatgttatgtccctgaatgtcttggtataggtttaagtgtgggacagtctgaaaattgatagcatttagcatttcttttttctcaaaaagaaactgtaggaaatacatgacagagaaagttacactcagggagcagcagcacctccagactggaaaaatatgttaatctttgcatcatattggactcttgaaggcaatccttcctctggccaggaaattttttaaaaaataatactgtgttgtgtttatctaaatacgtaaactcaagctaccaaagagaaagatgttgtaatcatatctgcatgtcctaaattttgaatttagatattccaatttgcatcagtctttctgtggctcaaataatgatgattatggaatgaattttaatgtccctacttgtgaataattagctttctcaaatgtaggctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaaatccttacagagaattgtttcacaaaacttatatttcatgtcaattgtatttattttaataatagctcacaatgcctttagtaagtaataaagtctcttattagaatcttgtattttttaattgagctaatcaaaataattcagccaagtctatttgaaatagaaaactgtctatttaatatagtaaaatcaatgctcccttaatgttgttacaaagatatggtaactgtaatatgggtaaaagtttattcaagaaaagagtacttggtagaagattctttaacaaattgaggagattgattcataattcacatgtcaattttttatagtaatatgtacttctaatttattatttatacttaaattgtgacctgaaagatgagttggagataattagtcaaagggcacatggagtatggaagggggcatgttgattaaccatacatagaaataaatattctcttagttatccttgaaatcatatttatactattaatttgctcagtgcacttttttcaaatacagaaaaaagattctccattatagttacaaattttaggttggtgaatccaagtgaatgaaatatcagcataactatgtgggcaaaatagatagaattaaatgcatgaattttcctcagacttattttatctgcctctgtaatatttaactttagtacccaggcttgttcactacttctgctttacaggctttatttaaatctgaacaatcctacagggaaatcagaattaggaaaaaaatctggagaacaatatggttgaaatagaaacaagagaatgcacctaggttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagtatgtgaccttatttggaaatactgtggttgtggttgtaagtagctaagatgaggtcatactggagcagggcaggcccttaatccaatatgactggtgttccttataagagaagatagggcgggcatggtggctcacgcctgtaatcccagcactgtgggaggccaagccaggcaaatcgcttgaggctgaggagttcaagaccagcctggccaacatggcgaaaacccatctctactaaaaataaaattagccatgcgtggtgcttgtaatgtcagctacccaggagtctgaggcacaagaatcactcgaacctgggaggtggaggttgcgagatcacaccactgcactccagtgtgagcaacagaacgagactctgtctcaaaaaaaaaaaaaaaaaggaagaaagagaagatagagacacaggggagaatgccacatgaagctggaggcagagattggagtgatacattgtgggaaccctcagaagataggaaaaaagcatggaatagattctccctcagagttccagtagttgccaaccctgctaacatggttttgcacatctagcatccagaacagtgagaatgtatttctgctgttttaaggtacccagttcatggtaatttgttacagcaatcctaggaagctaatactctgacagaaaaaaatcttggataatatgcatgagaaaaatccttcaataaacacaaaattggtttcaaaatgttttcatgtaaaaataaattaacttttctgtaattagattgtgttttatagtaattcttgcctgcttcttagtctttgttgtaggatgcataataaaatacatgaatgagttttaaatggttagctttggagaatggttttgggaagttcctacagtacacagaaataaaagctaatgttactatgaatgcgcattacttttctaataaaatgtttctgaatctc

SEQ ID NO: 74 - DNA, 1842 bp, Homo sapiens
tcaatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaagttctaaaggtcatctttgctgttgccttttgcctgatatctgctgtcctaatggtactactgtttatccacattcgccgtggactctgctggcagagagaatcctatgggaacatctgaacagacagctggataagccaggccaacctcctgtgacacagcatctctcagtggtgccgcatctaaaggacaggcttttgccatgtgggcattgccatcctcacaccctgccttttgaatctgcccagagcagggtctgaactcacagtgacccacaggctgctgctggatgaacactcaggctacctaggtcttctcataatggagtggtagtgcaggctgcttgttcagctagaaagaggctgttatgcataggatggttgtattctctgccacagttgtccggagagaaataagaagccaaactccaatcagccttttacctgcaaagagtgaagggtgagaaggtggacaaagacatagattagaaaaatactggatattgggggaagttagactagaagtattattatacagggtgattcttacgaaagaagacccaatcataaattataaataaactttttatttagctattaaaaaaaaaaaaaaaaa

SEQ ID NO: 75 - DNA, 4716 bp, Homo sapiens
ccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatgggtataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaattttttttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaaaaaaa

SEQ ID NO: 76 - DNA, 4344 bp, Homo sapiens
gggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgaaaaaaaaaaa

SEQ ID NO: 77 - DNA, 4906 bp, Homo sapiens
aacgaggcccttagggtcggcttaggcggttccctgaccaaggcgccagaaaagggcctggctcaagcaagcacgggcggcgtgcagtacagcacacctagccccgattcttcaacagttctcgccctccgagcctagcacaacgagcctcaccgaaaccgtacaccgccaccaggacactccgtgatgggggatcaccaccctcagaaagaggaagcgactagcaggcgcgcaatcccgcgagaccaggaggccccgcccgaagcccggcctctgtgaccggaagtgaggcgttttgccccgcccccgtggccgatacctcgcgagacttggcgaaggccttcctttttcgtctgggctgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttccttgtggtgtgagtgtaggttcttcagtggcacctctacatcctgtgtgcattgggagcccaggttctagtacttagggtatgaagacatggggtcctctcctgacttccctcaaatatatggtaaacgtaagaccaacacagacgttggccagttaaacatttctgtttataaagtcagaataatacctgttgatcactgaaaggcctgcatgtattgtactctgaattttacagtgaatgagagaatgtaccctaattgttcaacagggctcaaaaggaaagattccattttgatgggtcacattctaaagaggggcagtgtgataggaatgagatggtcctttaggacttaagttctcagcccaaggtttttccacgtggccccctcatcttttttttttttttaaacggagtctctcttgccaggctggagtgcagtggcacgatctcggctcactgcagcctccgcctcccaggttaagcgattctcctgcctcagcttcctgactaactgggattacaggcgcccaccaccatgcccagctaatttttgtattttcagtagagatggggtttcaccatgttggccatgctggtctctaactcctaacctcaagtgatctgcccacatcggcctccaaaagttctgggattatagtgtgagccactgcgcccggccatggctccttaatcttgatccaaattattgttacatccagaatgtgatgaatcaaaatctcgagatgggggtccagcaatctgaaatttcagtatgccagggcttttctgtatgtcaaagtgggtttgaaatagttaatttttcttctagtctgaaatgtatcgggaaaatttggaaatcctgaaggctggaaattgaaataagtttttctaggatttgtgtctcttgctattggaaaactgatggtgaccaattcatgtttacaaataagatcctcatagatctcggtaaattataatttgctacagttttatggttcttcctgtgattttgagctttttttgacccaaaataatacagtctaaaactatagacaaataagatggcacttagactcctgggttttagttagtggaggtttccttagtgcactgtggggtcataataagccgagaaccatggctgtctatgggacacatctgtcaggacaacctttagaggatgttggggatcaaatagaaggcacagagaagcactgaattggcttacataagaataggctagaattacaagtagtgaaacctcgattcagctggacaattttaaacaaatgtatcatttggcttgtatcttctgttgtgctggagaagttagaaataagggctctccagaccagcctgaccaacctggagaaaccttgtctctactaaatacacaaaattagccaggcgtggtggcacatgcctgtaatcccagctactttggaggctgagccaggagaatctccaggaggcggaggttgctgtgagccgagatcgtgccattgcactccagcttgggcaacaagagtgaaactctgtccaccccccccaaaaaaagtaagggctctccattagggcccatagaggacttgtaatatggaacctgaatccaaggatcccacaataagtggtcagtagttcatgatgaattaaaagactcaatatttggtcttcacccaatacctgtgtgacttttagtcctaatttcctcatctttaaaatttcagtgaaagtgcctacctgaggattgtgtagattaaaatggaaaccgtgcacttaattttttgttttgttttgagacggagtctcgctctgtcgcccaggctggagtgcagtggtgcgatctcagatcactgcaagctccgcctcctaggttcagaccattctcctgcctcagcttcccaagtagctgggactacaggcgcccgccactgcgcccggctaattttttgcatttttagtagagacagggtttcaccgtgttagccaggatggtctcgatctcctgatctgcccgcctcagcctcccaaagtgctgggattacaggcatgagccaccgcgcccggcccaggcacttaatttttgtgtttgacttagtaacttaagtgcaaactattacgggagcagatggagtcaattggccttcatgtgattgtcagtgggaaattggtccaagcagagggaatactggttcaggaaactggtttgggaaggttaggcaaacgggaagtgctatggtggagagaaagattactctggccgggctgtaaaggacggctacaatgggaggctgaaggcagaaccaagaaaatgggagtgagtatggaaaaggtacgattcagacggcataatggacgggacttggagactgaattgtagtgggccgaccacaaaatgataaggcatggaaggaagtagagtttggggggaaggatccctagtcccttaatggctaccttcttccccaggagttgttaggccatccgatcccctggcctgggaaagaaacactgatttcgttgctggcttgttcactcaccagaagctacagctactaacagttctaaaaactgtttcatgtgatgaggaacagacgaaaatagttttgagccctaagtccgccgattccagtgctttcttgaacccgcatttactaaaatattttcatgactgccaagctttgaatagcctgctgtgttcatggaggctcatactggcgatctctagtggctggctaaagcttgaattgcaaaagatctaatttctggtctaatgtatatatgccttaaatatagttgcgttcaaacgtgggagctgcaggtgcaacttgattttatgacaaatggctgccacataatttgcacaagcagtgctcgtcaagggcagctaaatcaggcgagctttcaatcaaaataaatgtactactaaaccctacttagcggctaactagcccaagagcagacagcccacggacggactgcaagtcggaagcgcgggcggaagctgtgcagcgcccacctggtggctccatcggccgcgttcatcagtcagcacgacccgacctcagtggcgtcctcacaacacagaccggaccttgggtcttaccccggcacctgagaaccacttccggtgagtagcttctacttccggagacgatgactcccccgcgtcccagaccggaagaagcccggcggagaccggcctcgctcggccacttccggcaagggcggagccggccagtggtgcgcgagcgcagataactcccctggagaggcgggatgttcaactccacccctggtccttgggcggccgtgggtccccttcgaagcggaggaatggccaacctcgccgcacttcgagcccctttagggtgcgtttaagaacagtgggcgtggcctttacgtaaatcttcgagatgggaacctccagaatttgtctcaattgtctaaaaggtaatgagcgtcagcgacattcaagggcactttgggctaaaaaagaaagtgcttgtacacggatggaaatattctagaagaacataaaaggaatttcctcttaggaggttagggaaatgagcacgaagtatgttttggtgcagttttttgttcaacccaatgcgtattttcatattgagaggcaatataaatggagcgaaagtatcttgagaaaaaaaaaaaaactaccagaacttgccgttgctgaaaagtaatattttctctttcgagagttttcatggccttttaaattacacccccacctccacaggcaaataaatttgttttggaatgcataccacatcatctggctctagaaacgtattttgtgtagctcccctagcaagaatataggttaaagcgtaaatttaattcctggctctattttacatcccaatttttattttcctctcattcccactttacgttgtttcaaataacctagtttgtgtatccctgtaagtcattttggtataaagtaggttataagtgtacatgcgaaaagatgtttttaacaaaaatgtaactgaaaaaaaaaaaaaaaaaaaaaaaaaaaa

SEQ ID NO: 78 - DNA, 591 bp, Homo sapiens
cttctctgggacacattgccttctgttttctccagcatgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagtcactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgcttaaaaaaaaaaaaaaa

SEQ ID NO: 79 - DNA, 2388 bp, Homo sapiens
attgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaatt

SEQ ID NO: 80 - DNA, 2239 bp, Homo sapiens
ctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgcaaaaaaaaaaaaaaaaaa

SEQ ID NO: 81 - DNA, 2636 bp, Homo sapiens
cacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcaaaaaaaaaaaaaa

SEQ ID NO: 82 - DNA, 10316 bp, Homo sapiens
ctcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtccattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 83 - DNA, 10698 bp, Homo sapiens
atgtccaaggtaacggcgcctgggtccgggccgccggcggcggcgagcgggaaggagaagcgctccttcagcaagcggctgtttcggagcggccgcgctggcggcggcggcgcggggggccccggggcgtccgggccggccgcgccttcctcgccctcctcgccctcctctgcacgctcggtgggcagcttcatgagccgcgttctcaagacgctgtccacgctctcgcaccttagctctgagggcgccgccccagaccgcggcggcctccgcagctgcttcccgcccgggccggccgccgcgcccacgccgccgccgtgcccgccgccgcccgcctctcccgcgccgcccgcttgcgccgccgagccggtgcccggcgtggcggggctccgcaaccacggcaacacgtgcttcatgaacgccacgctgcagtgcctcagcaacaccgagctcttcgccgagtacctggcgctgggccagtaccgggcggggcggcccgagccctcgcctgacccggagcagcctgcgggccgcggcgcgcagggccagggcgaggtcactgagcagctggcgcacctggtgcgggccctctggaccctggagtacaccccgcagcacagccgcgacttcaagactattgtgtcaaagaatgcactgcagtaccggggaaattcccaacatgatgcccaggagtttctgctgtggcttttggaccgagttcatgaagacctcaaccattcagtgaagcagagtggccagcctcctctgaagccaccatcagagactgatatgatgcctgagggaccatctttccctgtctgtagcacttttgtacaagaactctttcaagcgcaatacagatcttctttgacgtgtcctcattgtcagaaacagagcaacacttttgatcctttcctttgcatttctttgccaattcctctgccccacacaaggcctctctatgtcactgtagtgtatcaaggcaaatgttctcactgcatgaggattggtgtggccgtacctctgtctgggactgtcgccagacttcgggaagcagtgtctatggaaacaaagatccccactgatcagattgtgttaacagaaatgtactatgatgggttccatcgttccttttgtgatacagacgacctggaaacagtccatgaaagcgactgcatttttgcctttgagactcccgaaatatttaggcctgaaggaattctcagtcaaagaggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaagatttggactgccttttgtgctgcacttagagaagacaatagcttgggaccttctgcagaaggaaatcttggagaagatgaagtatttcttgaggcccacggtttgcattcaggtgtgtccattcagcttgcgtgtggtcagtgttgttggaataacatatttgctgccccaggaggagcagcccttgtgccacccaatagtagaaagggcattaaaatcttgtggaccaggtggcactgctcatgtgaaattagtagtcgagtgggacaaggagacaagagatttcttatttgtaaatactgaggatgagtatattcctgatgcagaaagtgttcgtctgcaaagggagcgtcatcatcagcctcaaacctgcactttatcccagtgtttccaactgtacaccaaagaggagcggcttgcccccgatgatgcctggcgttgcccacactgtaagcagctgcagcagggaagcattacgttaagcctctggactctgcctgatgtgcttattatacatctaaagagatttcggcaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcaaagtgttttatctgtaaagatgtttatttatttagaacccctgccctcccaccaaagcctcctgtgcttttgttttgtacttttttgagtcacgtgcccgactgtgtgtgtgtgtgtgagtgtatgcgtgtgtgtgtctaattcaattgcaaattgttcaaagcgtcgccttattctgccattgaaccaaataacagccataggcaaaacattgacaccaagctaactggaataattgtagacgatacccaggacggtccctttagcaattgtacatatttctttctagagaactctaatgactttctttggatatgagggttttgaaacctgtgaaccagaaaagctaccattagtgcgtagaaggaggaaggagctgactcgtgtttcttctgagcaggacttgtccttactgtggattgtgggtggcaccaggagctctaaaaactgtgactctaacaacgaaacaaatcgagggaaaaactcttgctttctgcactttcgccccatctaccagtctttgtaaagggcaatattttaacactaatgtttctcaggtatatactcagctagtctaggatggttgcacaccagtaaatggattaaagaggaaggtgccatgtgggtgactgtgtcatttctcctactgccacagatagacattttcgaggtagaaatgaagcctttcaccaccttcctatctgtggtgacatgtgcaccaaaacctgtcttgactcttgggataggtcctaggaagtggcagattggatagccagaaagccagtcactcgtttaattttttttccttctgaaattactagctaaggctcttggaattttgcactgtagtagagcagttaacacctttgacagattcctggaaaaaacttctagattctaaactgggtgaaagactggacatcattttccttgtcaggtgttgcatttttccgttagaggtgggaagctccacgatgccctgtgtctgtgggctcatgttccctcatcttgtagcttggagaggaaagaagttgccttctgccaaaagccaatggtggtatgttgaagcgttgtgtgatcaagtgttacatatgcacttcagatcctgtctgtcagtctctgttagggctgcctttcagtaactcatttattatttcttctttgttcttaagatttcatctcatgcccagaactcacaagcaggttttggagtgtgttccatctggccgtgtcagtgcaaattgcatttcttacaaaggagaacctcaccaaaaaaaacctcacagataagcaaagtatatagttttgcaagctttttcaaggtctcctggcaatactttcctgctcaatttttagcttttcttttttttttaaatgtcaagagagtgaaggtcttgattctctctgaatagcatttgtcactttgccagtaaatacagcatgctaagtttatgtgcttttaaatattagcgtttttcgtcagactcttcaagttcttcttgaacccttggtgcacagatccatatataacctcccttttcagtattgctgtgtgtgaattaactacaacacatatgcatgcatagctgtgaattctgcactactttttttttcttttttccccccaagaatatctcttgggaaaagtttttagtacgttacttaactttattttgctgctaatttgcgcattagccggtaacttgcaagtctggagaccacttactgttgagggtagctggaattttagacccttggcagtatttaagatttagacatttagccttgtgaaagttaccacagtgctccatgtgattcattgactgtgagcctgttgtccattgcactcagccctgtactcacttcttcactcgctgtcctggttttactgttcagattttggtgggttctcaaagcagtaccactctcatctgctcagtacatctgcggcaactggctgccttcgatgctgtcattgcgttcagcccagcacatcacagccccatcagtgtgtagccaccgctctcgtttttctgtatcgcttttatctcctgaaaaagatgcaccaaataagagatcatctatatcaggaattgaatgtctaactcaaacctctcatttttgtttaataggtagatctcatttgaagtctcctatctgaatctctgaaacaattatagtttgattagacaaaggtttttaataacacttcttttttgctgtagtcaagcattaatagaaactagtttaattttcacagtggtaaatatttttattcttgagttatctaggaatggattttccacgatgtctagtgacttaaaaaaaaaaaggaaaaacgtttctacaaatccctttggttttccatgggatctggaataaaatgtcagtgtctataaactgtatgtcatggagtttagtccttgtttcaggtttaatagaaaaaatcaggaagtatcatggcattgtctagacatcatgaagctattttatttccatagttggtaaacagtgaaaatttcattatctccaactactaggtacaactttaggccacaggaaaggttatttggcccgaaagtttggaggtgctccttgaggtgggaagtatcttgtgggaaagtagttacttgattcaatttagttcattggtagggttggggacttggtgttggtttctttctttcttttctttttttttttttttttaattttcccagcaatatttagcacaatgagcgtgtatgtgctttggggttaaaaattatctgctagggatgataggcctgggtttctcgttgacatctagatgggcctgattagagcagtcatctcctggtaggcacaaaataatcaccaacagtaatgttgtatctgtaatgtttgtttgctttttaaagttttattcttgatttcttgtaaacatccattgcactgaggccgtatcattccttaagacagccctacatcttgccttggtaatcccttagataatgtggaaactcaaaccgttaggctccagtcatcttagaccatttcccatccgttttgtattttctcgtcctgaaagcagctgaactgaaagtaagtaataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagtggcagcctttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctggaggtgcgtggaactttgtattatttgtagttgagaaaggcaaactttgctgacaaaccagtacctatcacaaacgaacacaaaaagtagctgttactgtgcaggctgtctttaactttcatttcataaagggtacattattgttaaactctactacatggtttggggagaaatccagtggttttatttaaatgaacactctcacactgccttttgatcaactttcaaagtattttgcagatgcattttgagcatgaccatttttttccccaagtaaaaacaattgtgcgtggcctccatataactcagaaagcatgctcttactacctatgcaagcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttcttgttttgctctgcatatatttctctgctgtttttctgatcattggcgagattgtaaagtattttgcaagcagaagtggaattggatatgttgaacacacatcattggtgtacatactgtatttagcctgaagactttcctaaagtgttttgttctaaaaataacctgccattttctatagattttaattttttatatcttcaagggttctattttggtcacaaggaaagaatgtggcttctaatagtgctaagaattaaaagatgcttttatagagacttagagctattttgaaaagctttggggcttcccagccactgatcacaattagactaagcccatggaatttctgggagtgttgtgcagtggattcggttctagatccatcttacatttgtttagtgtttcccaatttttgggagaaggggtgcacagcaaatttgagagacttttttgaatctcacacatgtattttcctcaagattcttttaagcctcttctgaatgacttgtctgagatagtgaagacccacattaactagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaatttcctacttttgctcattctctaggatagttcttatccagaatgtggtttcaggaattcttttttttagtttgaaaatgaatgtgaaacattttctttggtgtcttttttttaaaaaaaaaaaacccttattgctattttttcgtgtttttgttttgttttgttttttgtttgttttaccattaagtaatacacatcccagaatttggcactctgtgttaactgtggaggcaaataaaatttagttttaatctgtggtgagctgaatgcactacaacaccttcgaagtaatctgatggtttcattctgtcgagcctcatgctgcctacaaaacaccacaatttacctggtgttttcaacattttaaggaatgaagatacaagtagacatgcaagttggaaatgtttctttagaaaggccatccagaataatgatatctgttgcagtcgtccaaatgcaatatgaaatttcctaggtgctattataaacggtgtggtgtcataccaaatgcaaaagcagttacagtatttccgaagttggagttctctttgtaggcctttcaaatacgtgtttgcattccatagaggtctgctcaccaactgtgcctctcaccactggttaaaattgaatttaagcctcattgacataagtcgtttcttgattgaactcttcagtttttacactggaatttctgtagttgtcttgaaagctgcatgtcacatcactgtacacaaagtgctttggtattactcatgcaccgtggatagtgatttctgtgtcgttttcattttcagttgtacagtaatatggaaggcaggatgtctttcctagaggctggaagaaaagtgtatcgtacattttaaatttattttagaacaagtgcatgagatgtgtcactgatttctgttatttatttgtatgttttattattcaaagtgtatgcacttttaagaagcagaatttatatttttacgtttgaaacgttttatttctgaaacagcgttgattatatagtatacagttggaattaagagaaaagtggaaaatgtaacaaaatacaataaatttattacaagatgtcctcttca

SEQ ID NO: 84 - DNA, 1649 bp, Homo sapiens
agacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataaagggcattaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaaaaaaaaaaaaaaaaaaaaaaaa

SEQ ID NO: 85 - DNA, 3581 bp, Homo sapiens
atacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagaaaaaaaaaggaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcagataatggcagctttaaactcccagactgccgtgcagttccagcagtatgcagcccaacagtatccagggaactacgaacagcagcaaattctcatccgccagttgcaggagcaacactatcagcagtacatgcagcagttgtatcaagtccagcttgcacagcaacaggcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaagaatctcttccagtaatagcagctccatccatgtggacacgacctcagatcaaagacttcaaagagaagattcagcaggatgcagattccgtgattacagtgggccgaggagaagtggtcactgttcgagtacccacccatgaagaaggatcatatctcttttgggaatttgccacagacaattatgacattgggtttggggtgtattttgaatggacagactctccaaacactgctgtcagcgtgcatgtcagtgagtccagcgatgacgacgaggaggaagaagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaaaaaaaaaaaaaaaaaa

SEQ ID NO: 86 - DNA, 7589 bp, Homo sapiens
ccagcggagggcgggccgcggggggcggccgagcagacggcggcggggtcgtgtacagcgggaccccgtggaaacggaggaactacaaccagggagtcgtgggtctgcatgaagaaatcagtgatttttatgaatacatgtctccaagacctgaggaggagaagatgcggatggaggtggtgaacaggatcgagagtgtaattaaggagctctggcccagcgctgacgtccagatatttggaagttttaaaactggactttatttacctactagtgacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatggaaatggtgttaccttgatagtagatactcagcagttagataaatgtaataataatctatctgaagaaaatgaagcccttggaaaatgtagaagtaaaacctcggaatctcttagtaaacactcttcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgcatatatttaccattttattgtgtgtatatatagaagaccatataggagattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaagaacttttagtttgcctgctcatttgttttatacatttcatctatttgactcctatcttatttcttttttgagttttaatacttcctatattttgtgaatatatcagaaatgtgtcatttatatattagagtccattcatatccatgaatcataaccttcctttgctaatacttgttgaatgggattttacaaattctccctcactctggtgacatttctcaggcagtcatgtatgtgtacctggccattagaaatattaatatttaaagactgttttttagaggagctgatgggttggtgaggtgtcagcacaaaatcttactggttatgttttgatgataaaagtatatccattttttccctccagctttaaggtgactgtgaaggtgcctggttttgaatgtctttgtttggtttggagatgtcgcactcagttttcaaatctagcttggatctgtaggacctatgttttttacaagtaattgccctccagtcttcaacagttgattctgttttatttttatcctgttttgagtgtactttacctttacttgcattttgagcctcattaatatttaggttatttgatttggctccagatattcctagatctgcacagggcaaaacatgggctatagggtgagcatttttaattgtctttttctgctggaaccttatatctctccatgtgttttctgctccttccctcccccatgaaatggtaagtgtgacttgtgtttgcctgaacctgtggactagtgtttggggtttctggaaacactagagggtcagaaaagagtaatgaccaccgtgacgtgcaggattctcttgctgtgacatgttcattgcaaagccctctccagtgactaggaggtgtagttattaaggttgatctgttagaaatcaccattattaggtattagtggtagatgttgctgatacttttattggtcatgactacatctcagttttactttaatattgatctatagtttgatcagttccttgaattctaatatgttgatttctcagtgtttctgtcactaaccaagaatgtttctaggcagttggttgcttcacagtcaaaactaaatggtaaactatcaaaaatacattcccaattttgctgtgataaatattgaaatgttaaaattaatgaacagaagaatttattcttacccatctattcttgttctcctagttcattaaactttcagttattggaaaggcacattctcaaagtattttatgagcaaaatattctataaatgcgtctaacaaacctaattgaatataaaagttatatttagtagttactgttgatagtaattttcatcagggtcatagttcatctagtaaaatatttagagaatgatgttaacattccagcattaaagtgggaacaaagatttatatatgaaattccttaaaagagttcatcttgccttggtttctgaccctcaagactctagctacctgccatcttgtcaaaacatttgtgggtagaataagtgttaaagatcaaattttaatatgcttctcgatatttaacatagctaagaagccagattttactgtagaagttatttacatgatttgaaaacttgacctaactggaagcctttttctcagtcatcttgttctaagccatcttgacttcacacccttagcgacttttcttttttttttggtcaaagataatgagctaaatatatatagacgttgaatgttgacaaaattattaaccagaaaaattgcttataaaggctgctgatctatttgatacctagaattaaatatttgaggacagtttttagttaataaactgctaatgtttattttactgtctctcaggtttttggtttttttaaaaaaaatgtgtttggcctttacattttctacttaagtgtgtactttattgagtttaaccttgtctgtagcctagtagcctgaaagaaaaggagacagaaccagagagatggatgtagtgcattccctttggttattacacatttgtggtagctcctggatttactgagagatattttagctatgtcaataagaacagctaatgatgtggaaatcaggtgttctcttgtgtatttcagtgaacatttttattagtagttgcatatcatctctagttccacattttaacttaacgtctttgtggcttcaccactgagctacctttcactacaccagcttctgtgtggcctggtaacatggaaggtctctcctaaggacagtctggacgtattttgggggaatgttatttatcttaaagatgcctagaaacaaaacgcatatagtaccagtgagaaactatgaagtaaacaagttgctcaggccgggcatggtggctcacgcctgtaatcccagcactttgggaggccgaagcgggaggatggcttgaggctgggagtttgagaccttcatctcttaaaaaaacaaacaaaaacctgaatggtgaggtgtggtggaattgggtaggggagggaaaggaggacttggaaaagcattctccaaagccagcaacttggtgaagttcagtacttgcctcttagaggttaggccatgcctttcaaagagagtgaaatgatgggttatcagccacattcttggagttaatatttttcttcatctttcagtttgggttctgtgctattcatagttcttccctaagaccatttcattattaccttttatatttagttgcaatttattataatatgttgttttgtccctgaacttaatctcctaattttaagatcctctctgatttttgcatattgaaacttacagaagtcactttaaaaaagtcttttgaaagtcctacaatcctaaaataaatcacaagcttgtttgttagacgtgtcaagagtctccagtctttactactaaaaagcagcactgccttaacacacattgttatgggtgaaaagtgagggacgaccagtgtagtttctggatataaagtgtgaaggactgttgagttaaacatttttagtggaatatacatagataacgtgtatttagaaactttggtgaagccagtatttgtttttagtaacctttttatgtatttccttctttgattagcattgtcttcagtgttaagaaatgtggactcctgtgaggtgctggaggtttgaatcatcttgaaaactttccaatcttgtctagttaccactgcagagacactaaggaatttaccagaaaaagatatttgatacaagtgatttaagaaatctcaacatttcctgaggccgtatcactgggcaaccagtgatgaaaactatgaatgaattgcacacctggaagattttttaagctaatgacagtttcttcaaagatgtcaattatttgccttggaaattttataaattgcatttctatgcacatcggcctctagtgcttaccactcggtttattattcataatctgcaattcaataaaggctttgtgttttcatttatcttcaaaa

SEQ ID NO: 87 - DNA, 1638 bp, Homo sapiens
ggccaaagcggagcggagcgggggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaaaaaaaaaaaaaaaaaaa

SEQ ID NO: 88 - DNA, 1299 bp, Homo sapiens
gaattggcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtc

SEQ ID NO: 89 - DNA, 1712 bp, Homo sapiens
aagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcactgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtaatttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactaccatgttaaaaaaaaaaaaaaaaaaaaa

SEQ ID NO: 90 - DNA, 721 bp, Homo sapiens
gagagactcggcggttgaaagcagggaggcgctacaggagagaaagggctgaacccccgcttccgcagatttcacctatttttcagtttgcctggagcaggccacgcaaattcccttcccttgaaggcccaaggagcgtctggtagattgctgattctctgcccatcaccgcttctggaagtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaacatttaaaaaaaaaaaaaaaaaa

SEQ ID NO: 91 - DNA, 6369 bp, Homo sapiens
cccacgcgtccggccttggcggcggacgtgcagagaatctcgatgctggcctggagcagaaactgagctggaccactggagcctcggtgagggggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctgaaaaaaaaaaaaaaaaaaaaa

SEQ ID NO: 92 - DNA, 942 bp, Homo sapiens
tacgaatctcgcgagaagtcaagttctcatgagttctcccaaaatccaccgctcttcctctttccctaagcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaaaaaa

SEQ ID NO: 93 - DNA, 752 bp, Homo sapiens
ggggaagccatgtcctacttcaggactccacaaactcatccaggtcctctgccttccggccaaggtggggctgcttctccaggcttgtcccttggcctctgtagtcctgtagagccagtggtggtggcctctggtggaacaggcccactgagccagaaagctgagcaggtggcacctgctgcccaggcctggggcccagccctggcaatgccacaagccaggggctgccctggggggactagctgggagacactacggaaggaatacagccgaaactgccacaaattcccgcatgtgaggcagctggagagcttgggctgggacaatggctactccagaagcagagcccctgacctgggtggccccagcaggcctaggcccctgatgctgtgtgggctgtcaccacgggttctaccggtaccctctgaggcagtggggaaggaggccagctcccagcctgatatctgcatcctcaccctcgccatgatgatcgctggcatccccaccgtgcccgtcccaggagttcgggaagaggacctgatctgggccgctcaagctttcatgatggcccatccggagccagagggtgctgtggagggggcgcggtgggagcaggcacatgcccacacagcctctgggaagatgcccctagtgagatctaaaaggggccagcctcctggctcctgcttgtagatggatgaaatagcaccagatatgtaaaaaaaaaaaaaaaaaaaaaaaaaaaaaaaaaa

SEQ ID NO: 94 - DNA, 1665 bp, Homo sapiens
ccggaggagtcacgtagctctgcgacatccgcagcctcatttaccagagggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattctaaaaaaaaaaaaaaa

SEQ ID NO: 95 - DNA, 1035 bp, Homo sapiens
ggcccttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaactaaaaa

SEQ ID NO: 96 - DNA, 1841 bp, Homo sapiens
actgcgccgccaccgtcaataggtggaccccctcccggagataaaaccgccggcgccggcgccgccagtccctctggctgagacctcggctccggaatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggtgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggagaagaagagcggcggcgccggcaaggtcaccaagtcggcgcagaaggcgcagaaggcgggcaagtgaagcgcgggcgcccgcggcgcgaccctccccggcggcgccgcgctccgaaccccggcccggcccccgccccgcccccgccccgcgcgccgctccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccag

SEQ ID NO: 97 - DNA, 1650 bp, Homo sapiens
cggcaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcggcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagcaaaaaaaaaaaaaaaaaaaaaaa

SEQ ID NO: 98 - DNA, 4246 bp, Homo sapiens
agggctccacagtcgttccgccacctcccagtcgggttgcggcggaggccgttcctggctttgtagctcgctcaagatggcggcgcagccaccccgcgggatacgcctcagcgcgctttgcccgaagtttttacatacaaattctactagtcacacctggccattcagtgcagttgctgaattaatagataatgcttatgatcctgatgtgaacgctaaacaaatatggattgacaaaacagtgataaatgaccatatatgcttgacattcaccgacaatgggaatggtatgacttctgataaattacataaaatgctaagctttggcttcagtgacaaagtcaccatgaatggtcatgtcccagttggattatatgggaatggcttcaagtcgggttctatgcgtctgggtaaagacgcaatcgtttttaccaaaaatggagaaagcatgagcgtgggccttttgtctcagacctacttggaagtcataaaagcggagcatgttgttgttccaatagtggcattcaacaagcaccgacagatgattaatttagcagaatcaaaagccagccttgctgcaattctggaacattctctgttttccacggaacagaagttactggcagaacttgatgctattataggcaagaaggggacgaggatcatcatttggaatcttagaagctacaaaaatgcaacagagttcgattttgaaaaggataaatatgatatcagaattcccgaggatttagatgagataacagggaagaaggggtacaagaagcaggaaaggatggaccagattgcccctgagagtgactattccctgagggcttattgcagtatattatatctaaagccaagaatgcagatcatcctacgtggacagaaagtgaagacacagctggtttcgaagagtcttgcctacatcgaacgtgatgtttatcgaccaaaatttttatctaaaacagtgagaattacctttggattcaactgcagaaataaagatcattatgggataatgatgtatcacagaaatagactcatcaaagcttatgaaaaagttggatgtcagttaagggcaaacaacatgggtgttggagtggttggaattatagagtgtaatttccttaagccaactcataataaacaagatttcgactatactaatgagtacagacttacaataacagcactaggagaaaagctgaatgattactggaatgaaatgaaagtgaagaaaaatacagaatatcctctaaatttgccagttgaagatatacagaagcgtcctgatcagacatgggttcagtgtgatgcctgtctaaagtggcggaaattacctgatgggatggatcaacttcctgaaaaatggtattgctccaataaccctgacccacagttcagaaattgtgaggttccagaagaacctgaagatgaggatttggtacatcccacttatgaaaaaacctacaaaaagaccaacaaggaaaaattcaggatcagacaaccggaaatgatccctcggattaatgctgaactgttgtttcggccaactgctctttcaactccaagcttttcttctcctaaggaaagtgttccaagaagacatctttcagaaggaacaaattcttatgcgacaagacttctaaataatcatcaagttccacctcagtctgaacctgagagcaacagcttgaaacggagactttctactcgttcctcaattttgaatgcaaagaatcggagattgagtagtcagtttgaaaattcagtttataaaggtgatgatgatgatgaagatgtcatcatcttagaagaaaacagtacccccaaacctgcagtagatcatgatattgacatgaaatcagaacagagtcacgttgagcaaggtggtgttcaggttgagtttgtgggtgacagtgaaccttgtggccagactggttcaacaagcacctcatcatcccgatgcgaccagggaaatactgcagctacccagactgaagtaccaagtttagttgttaaaaaagaagaaactgttgaagacgagatagacgtaagaaatgatgcagtgattctgccctcctgtgtagaagctgaagcaaagatacatgaaacccaggaaaccaccgataaatctgcagatgatgcaggctgccaattacaagaactgagaaaccagctactccttgtcactgaggaaaaagagaattataaaagacagtgtcatatgtttactgatcaaatcaaagtgttacaacagaggatactagaaatgaatgacaagtatgttaagaaagaaacttgccatcagtccactgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggttgaattgctggaaatggaaaagtcacaaatccgttcacagtgtgaagaactcaaaactgaagtagaacagttaaaatctacaaatcaacagacggcaacagatgtttcaacatcaagtaacattgaggagtctgtaaatcatatggatggagaaagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatgtaagataaaatatttgctcaattcttttggttgtacagctttcaaaatataattaattttgttttatagatatgataggcaacagactgaaaaccataatctttactgtattctatgcattcaaatgtggtcacaaatattgtggacacattatcttatgttttgaaatacctgtgaattgttggcattgagcagctgaagctaactcatgactctgttttgaatgtaaatatttgtaattaagcctgcacatatttttttattgccctagagtactcaagtgtttttcaccaagagcttttcaggttgcccctaagctttgtgcaattttttctggttccccaaagtgtatttttctctaagtcgagggctatgccataatacaaatggaaatgttacctttgattttcttataaaggagtttaaataggatttttaaataatgtagtaacactcctgatacaactctggttataagtgaattgagcattaatgtttcttttgtataaattcctgtcctgaaatattttattcatgaaaataaggtaagcaaaaaccaactccattttgccaggattttgttgtgctgagattgccaatcacggttaaacacaaagtgtttttatagaatgaagaaacagtctttaacagaaaaaaggtattgaaatattaaatggccaccaagtttactttgaagcccatttttggctgtttagtcagcatgaagtgggcatgataattttttaatatttctttttgtgaaatttcctgtacagccttttgtaggattactacaggttaatgtgagttgaggaagacagtctttctcaaacaatactacataccttttattatattacaaacctaagtgttttatatcctagagtcaaggaacaaatttccttaggattatagtattacatgccataaaatactatgctttattggtcccatgttttgtgcaattttaaagagatggctttctattaagtataaactatgtatatataagaaccatattttccacaactaaaatgtgcattattttttccaaagttttatcattgctatttatttttacctttgtttttgaacattcaatccgttcattttgtatgtatgcttaatacgtgtcggtcatatacagtattgaatttttactgtatagtaattctggaaagagcaaataaatgaagattgtttttatttgcctgataaagtaattgaaagtgtatttttggtatgaagctggttttctgtcacaattgtaatttcccaaattttaaaatatcttataataaaataaaaatatatgatggctaactgttcaaatgcta

SEQ ID NO: 99 - DNA, 1561 bp, Homo sapiens
gggttcccaggccgactctccttgtggttggctgaggctggaggtggacgggacttttggagggtcgctcgcgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtgggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctgggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaatttatcttaaaaaaaaaaaaaaaaaaaaaa

SEQ ID NO: 100 - DNA, 4314 bp, Homo sapiens
cgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaac

SEQ ID NO: 101 - DNA, 3608 bp, Homo sapiens
gcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccgggtcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggggtgtcttcatgacaagaacagcgaccaggccacttggctgaccaggttgtgagcagaggattctgtgttcctgtccaaactcagtgctgtttcttagaatccttttattccctgggtctctaatgggaccttaaagaccatctggtatcatcttctcattttgcagaagagaaactgaggcccagaggcggagggcagtctgctcaaggtcacgcagctggtgactggttggggcagaccggacccaggtttcctgactcctggcccaagtctcttcctcctatcctgcgggatcactggggggctctcagggaacagcagcagtgccatagccaggctctctgctgcccagcgctggggtgaggctgccgttgtcagcgtggaccactaaccagcccgtcttctctctctgctcccacccctgccgccctcaccctgcccttgttgtctctgtctctcacgtctctcttctgctgtctctcctacctgtcttctggctctctctgtacccttcctggtgctgccgtgcccccaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccaggggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagttaaaaaaaaaaaaaaaaaaa

SEQ ID NO: 102 - DNA, 4528 bp, Homo sapiens
attaagccgcgcggcagctgctcgcagccggagctggtgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccatcggcgctgaagaaattgttgatggcaatgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagacatcgtgaacacccctaaacccgatgaaagagccatcatgacgtacgtctcttgcttctaccacgcttttgcgggcgcggagcaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagaggggaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattgcccctaggggagtatatttgggattctaatgttttattttcatgcttatccaaagattactattgtatcttcaaatgaatttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtaaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgcc

SEQ ID NO: 103 - DNA, 4004 bp, Homo sapiens
gtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacacactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtac

SEQ ID NO: 104 - DNA, 5233 bp, Homo sapiens
gatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcaggtagaggtgatggtggaagagaaaacaactgaaagccaggaggaaacagtggtaatgtcattaaaaaatgggcagatcagttcagaagagcctaaacaagaggaggagagggaacaaggttcagatgagatttcccatcatgaaaagatggaagaggaagacaaggaaagagctgaggcagagagggcaaggttggaagcagaagaaagagaaagaattaaagccgagcaagacaaaaagatagcagatgaacgagcaagaattgaagcagaagaaaaagcagctgcccaagaaagagaaaggagagaggcagaagagagggaaaggatgagggaggaagagaaaagggcagcagaggagaggcagaggataaaggaggaagagaaaagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaaaaaaaaaaaaaaaa

SEQ ID NO: 105 - DNA, 1056 bp, Homo sapiens
tctctggctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctaccaaaaaaaaaaaaaaaaaaaaa

SEQ ID NO: 106 - DNA, 5375 bp, Homo sapiens
ggggccggtctcgcgcggtctagaagtggagttgctggcggctgcggcggtgacggcggcgacggaggaggcaggcggtggggcgggggcggggactaaggattctgaggtggggagtcgggagtttctggattctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataatatttccttcatggatactttttcatagcattattatgtgatgtgagaagtttttttttttgaagtaacatggattttatactacagaatcaagagaattggcttataggaaaaattgatttataaaaagtggtacaggttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaagccaaaaaaaaaaaaaaaaaaa

SEQ ID NO: 107 - DNA, 1791 bp, Homo sapiens
gagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaaaaaaaaaaaaaaaaaaaaaaaaaaaaaaaaaaaaaaa

SEQ ID NO: 108 - DNA, 1574 bp, Homo sapiens
tcaccacggcggcagccctttaaacccctcacccagccagcgccccatcctgtctgtccgaacccagacacaagtcttcactccttcctgcgagccctgaggaagccttgtgagtgcattggctggggcttggagggaagttgggctggagctggacaggagcagtgggtgcatttcaggcaggctctcctgaggtcccaggcgccagctccagctccctggctagggaaacccaccctctcagtcagcatgggggcccaagctccaggcagggtgggctggatcactagcgtcctggatctctctcagactgggcagccccgggctcattgaaatgccccggatgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaatcaatcttttctcaaaaaaaaaaaaaaaaaa

SEQ ID NO: 109 - DNA, 4232 bp, Homo sapiens
cggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctgatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgtcggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacaccaaaaaaaaaaaaaaaaaa

SEQ ID NO: 110 - DNA, 2866 bp, Homo sapiens
ggattcggcgcaggcgcagtccgcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccatgcacgcgctcaagccaccagggtgcgagatgccagctctggagttctcggttgttgtaggaggttgggtgttttcaaatggtaaagatgttttgagcaaataaatttgcttgatacagaaaccaggccgactaacaaggtttccagcaggtggccttgcctcaccccaagcacacgaggtcagcctggcaggtgtgccctcctcgcgctggcttcaggggtcagtgtctccccaggccctcgccctgccctcccacttcgtgctcctgggtaaggcgtgagcgtgtctgtctcttcccttcccgtgagggtgtggagttgttctctggcttgtgcagctgtggtttgcggccagttcctcttacagacgtttgggatctggctctacttccccgtttgcttactgtctgatttcagaaggcctcgcctgcccaagtttaacctagccacgtggttctctcacagtagctttattaagatgtaattcaccctcgggcggtcggtggtctgtaacgcgcccactgttctgtgcagcagggtccccagatccccaggccgcggactgtgtgtgtgatggggacagtgcttccccttctctccaaatgtacttttttcaaaattgtcttggccaaagcaagccagacccaaagggacaaacactgatgtcactcctaggaggtcactagagtcgtcagagactggaagtaggatgggggttcccgggactggggagttgggtggggatgggggttcccagggctggggaggagggaggggacagagtgtgtcatgtgcacagttttagtttgggaagatgagaaaattctggaggtggccgggcgcggtggctcacgcctgtaatcccagcactttgggaggccgaggtgggcggatcacctgaggtcgggagttcgagaccagcctgaccaacatggcaaaatcccatcactgcaaaaaatacaaaaattacctgggcgtggtggtgcatgcctgtaatcccagctacttgggagctaaggcaggagaatcacttgaacccaggaagtggaggatcgcttgagctcaggagttaaaagaccagcccgggcaacacagagaaaccccccacctctacaaaaaactttaagattacctgggcacagtggctcacacctgtaatcccaacactttgggaggctgaggcgggaggatcatttgagcccaggaggccgaggctgcagtgagctacgattgtgctcctgtactccagcctgggccacagggtcacaccctgtctcaaaaaaaaaaaaaaatgcagttccacaggcgcatgggccacgtttccagtgcttggtggccatgtggggctgacgtgcgaaaccttagagccgggggatacgtccgtcatcgagaacgttttcctggactgccctgggctgcaggtggacgtgacgaggtcattcgatgcctgaccgtctgcacagcctgtggtgaagaccacccgggctcccacctcgcggggccccgtggcggggggttcccttcctcacacatccctcccctagggggaggcccagggccacgccacggggctctctctgtcccctccctggccccttcttctaagcttgcagctgccacagaaaatcttctaagcttgcagctgccacagaaaacacccgattaaaaactttttatttcagcaaaataaacgtgcctgtgaaagaa

SEQ ID NO: 111 - DNA, 1716 bp, Homo sapiens
agtgcgcctgcgcgcttgtggagctggtggcggcgctccgcaggggctcggctgttttccgcgcggcaggcgcggccatggcgcagctgggaaagctgctcaaggagcagaagtacgaccggcagctgaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaaaaaaaaa

SEQ ID NO: 112 - DNA, 9501 bp, Homo sapiens
ggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgacttttactttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 113 - DNA, 2934 bp, Homo sapiens
aggacgcacagagccccgcggctaccgccttaggggttgtcccggcggtggggaagccattgaggagtttaacgccggaaggtggtgactaatcagatttcacttgaaaatggcacggtgtctgcagcgaggctaactgatgggaagggcccagcgaatgccaataggagagagcaccggacctggaaggcctgggtcaacgcggccccgcgcgggggcgaagcggttccggcgcaggggcctggcgcggggctccgcggaaaaccgaaccggcccacgtgggaccggtcgctccgccctgctgcgcagacgccgcctgactccgcagtccgggactggggctgggcgcgctgcccgggagccccgcacccacgcctggaccgcggagacgcccaggccgaggaacccccagcccagggactagacaccaccagggccgggcggagccagagccagacgcgccggagcgggcgcctctacgccgctagatgttcgccatccagccagggctagctgaggggggccaattcctgggggacccacctcctggattatgtcagcccgagctccaaccagacagcaactccaacttcatggcaagtgccaaggatgctaacgagaattggcatgggatgccaggcagagtggaacctatcctgaggaggagctcctctgagtcaccctctgacaaccaagccttccaggcccctggatcccctgaggaaggggtgcgcagccccccagagggggcagagattcccggggctgagcctgagaagatgggtggtgctggcacagtctgctcccctctggaggacaacggctatgccagcagttccctgagcattgacagccgtagcagcagtcctgagcctgcctgtgggaccccgcgaggccctggccctcccgatccccttctgccctcagtggcccaggctgtgcagcacttacaagtccaggagcgctacaaagagcaggagaaggaaaagcaccacgtgcacttggtgatgtaccgtcgcctggcactgctccagtggatccggggcctgcagcatcagttgattgaccagcaggcccgactgcaggagagcttcgacaccatcctagacaaccggaaggagcttattcgctgtctccagcagagggcagcaccatccaggccccaggaccaggcctaagggtgtgcctccacaagtgtgcaagggtatatgtatatatttgcaggcatgtgtgaggcgcactagtaagtacataatttgctggcatgattgcaggtaggcatgagtgtgtatgtgctaacatgtaggctggtgtgtgtaggcatgtgtgaataagcatgtataaatgagcttaagtgtgctgtgtgcacatgtgtacacacagctaatttatctgcagacctatatgtgagcatgtaagagtgaacatatgtgtgtgtgtgtagtatgtaagaatgaggaactcggtatgtgcatgtgtagacaggtacccagcagtgtgtgtatatgcgcatgagtgaggatgtataggcagaagatgtgtgtgtctatgagtgagtttgagtgtgcaggcttgtattaggtgtatgtgaggaagcccttgtgtgtgcaggggtgcacatgtttggccacaggcatgggaggtgtatgttaggagcatgtgtgtttgtaggcagactcatgagcaggtgtgtgcaaatacatatccagctgcactgtgggtgtccacccacaccttgtgttcctcatggcctaccccagcctttcttctccactgggtcccactgttccctggagacagagggctagcatgctgtcatttatctgaaggttgtggctgacccattctcctgggatttcccaggccacctctcctttccctttccctcacttaacccagacttgctcagctgaggctattgtccctgatgttggctttacttgtaggaggtttagtggctgctctggcctgccatggaattttggctgcaattttggcagtgtgtggagaactggtatcaggaaagggaaccaggagtagtgatgaagatgatggtggggatggggacagaggacataggggactgtccctcttgaactctgcctttgggcacatgggagatggggacaggaaagatgataacagtggaaccctgtgaagaataggagaatgggaattctaaaataccagttcccaaacaaaccatctctccattggaaaaggagctgttgcaaaccgtgttcatttaagcttctgatgaaaagcaatgtatgtttataagcttgcaagtaacagacaagatgttccaaggccgatgaggaaaatatcgcttccctgtctctgcctctaccttgctgtgcctctctggctttagcagcattggatgttgaattggtttggttcatttctctgaagtcggactgtcaggaggagccagaggttggctttctgggatgtgaaggggacagtgtcagcctaagcctctggagatgcttaggatgctgaattttaaccccttctttcactgcatggcccttcaaacagggattggcaggctccgcgagttacagagtgggtgagtcttggagagaaccaacgactaaggtagcttagctctctgctttgttcttgggagccaagagaatgcaagatcctggtgggtgagcagtggtatgaagaggggacactggtgggtgaacagtggcatggaagtcactgatgcagcctctggccctcagtctccctatcggcaaagtggggggctcttcctatctctaaagagtttcatccctgacaggtggatgggtgaaagatccagagagtgggggtgaggggtgggccctgaagactttttgtctgtagctcttgcatattgagtgtataaacccggcttctggaccaacccaagatgaataaactggggcagaaaattac

SEQ ID NO: 114 - DNA, 1931 bp, Homo sapiens
acttccgccgcggtcccgcccccagcgtggtcgtaacccaaggcaacggcccatccggcagcgacctgagtagctcttgccagtaggccgggactagctgtctcggggccttccatccgcttggccccacagcaagaagatgttaaaaactttaagcaagcatcacagtaatggatctctgtcagaaaaatgagactgacttagaaaatgctgaaaataatgaaattcagttcacagaagaaacagaaccaacctatacttgtccagatggaaaaagtgaaaaaaatcatgtttattgtcttctcgatgtcagtgacattacgcttgaacaagatgaaaaagccaaagagtttattattggaactggatgggaagaggcagtccaagggtggggaaggacttctccagctgcctgcatctggccgaggaagataccaaaaaaggcgagggtaggggaaggtgcctgcagcgactgcttggtgtgtgttaacctctcccactggagcctccagaccaagcctcctactgaggggggcccagagaaggatcagagcagcccctcccagactcaggcagccccccagggccccagcactgcttccagggcaattagcgacatctgctttcccacctactttcgagcagagaaaaaaagtctgcaaatcaaggagtttatttggtgcaacaaagactgggccatccccggcactaataggggcaaggcctctgggaatcccagtggaggggcccacagagggctgtccatcccaggccccctgacttccagggccctcctagttctgcctcccctgaaggcttcactttcaaatgctttggatgttctgggtaagaagagtaagaactctttcttgcagtcagaagagaaggtgctggatgtggaaaaggatgggtgtgtggcttatgcatatggcttgaaaacagcagatgggaaaggtgaaaaaagagccagtgagctggccaaacaccctatggtcaacgacacgccatcctccccttccccagcggcccagatatccctgctgaccgatccggagcagcgctgcctgcattggtccctcctgtctgagaaaaacctggcgtgccctccagaccccagcaacgttcgctaccttgctgccttgcagcttctgcagaaacggggagtgcaaagctacaaatccaaattcaaagccaaggagccaagatctcctgtgatcacccgaaagcatgttctcccaaaggccaagcaggaaaacaggccccaaatgctggagaccaaagttttcccaagacctgtcttgccgtctctcacacacaggaaaaagaagataaagtaggagagggatcagtttcacattcagtcctaagcagcaacacggttgagatgtaatcataaaagcaaatatttcacccaggacatggaaaagcggcggatcaccagaaagcagagagtcaaacgctgcaagcagaagcagtaagaagacgccacgtttggagcaaggtcttatttacacctgccatggtcatcggctcgctcttttaggtctccccaacccggcccccaaaaagaggttatatgcagaggtaatataatatatgtacttttgaaaataacaaagtcaccgtggagataatttcaaaacaatttattttcattttcagatacattggactatttcactgatgttaaaaagagtatgacttgtttaaattttttgttgtttcttttttgcagcctaatgttctgtaatagtaacttgcttccaagtaaagtatgaaaagttagtggaggggccatggctgtggtctctgataggtcaaactatactattttggaatgcgtggagttagaacaaagtttttattttgttattaattagtaaagcaataaataaaattgtcttactaataaaaaaaaaaaaaaaaaaaaa

SEQ ID NO: 115 - DNA, 3968 bp, Homo sapiens
cccgtccattgtgcgccgctgccccgtgtctccctccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgcgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagttttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaaaatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcttggaaaaaaaaaaaaaaaaaa

SEQ ID NO: 116 - DNA, 793 bp, Homo sapiens
  misc_feature (166)..(166): n is a, c, g, or t
  misc_feature (183)..(183): n is a, c, g, or t
  misc_feature (234)..(234): n is a, c, g, or t
  misc_feature (236)..(236): n is a, c, g, or t
  misc_feature (255)..(255): n is a, c, g, or t
  misc_feature (306)..(306): n is a, c, g, or t
  misc_feature (320)..(320): n is a, c, g, or t
  misc_feature (331)..(332): n is a, c, g, or t
  misc_feature (338)..(338): n is a, c, g, or t
  misc_feature (348)..(348): n is a, c, g, or t
  misc_feature (354)..(354): n is a, c, g, or t
  misc_feature (360)..(360): n is a, c, g, or t
  misc_feature (365)..(365): n is a, c, g, or t
  misc_feature (391)..(391): n is a, c, g, or t
  misc_feature (397)..(397): n is a, c, g, or t
  misc_feature (405)..(405): n is a, c, g, or t
  misc_feature (416)..(417): n is a, c, g, or t
  misc_feature (423)..(423): n is a, c, g, or t
  misc_feature (430)..(430): n is a, c, g, or t
  misc_feature (442)..(442): n is a, c, g, or t
  misc_feature (444)..(444): n is a, c, g, or t
  misc_feature (456)..(456): n is a, c, g, or t
  misc_feature (463)..(463): n is a, c, g, or t
  misc_feature (465)..(466): n is a, c, g, or t
  misc_feature (490)..(490): n is a, c, g, or t
  misc_feature (516)..(516): n is a, c, g, or t
  misc_feature (518)..(518): n is a, c, g, or t
  misc_feature (520)..(520): n is a, c, g, or t
  misc_feature (548)..(549): n is a, c, g, or t
  misc_feature (552)..(552): n is a, c, g, or t
  misc_feature (555)..(555): n is a, c, g, or t
  misc_feature (559)..(560): n is a, c, g, or t
  misc_feature (562)..(562): n is a, c, g, or t
  misc_feature (565)..(565): n is a, c, g, or t
  misc_feature (585)..(585): n is a, c, g, or t
  misc_feature (593)..(593): n is a, c, g, or t
  misc_feature (600)..(600): n is a, c, g, or t
  misc_feature (609)..(609): n is a, c, g, or t
  misc_feature (614)..(614): n is a, c, g, or t
  misc_feature (619)..(620): n is a, c, g, or t
  misc_feature (624)..(624): n is a, c, g, or t
  misc_feature (628)..(628): n is a, c, g, or t
  misc_feature (630)..(630): n is a, c, g, or t
  misc_feature (632)..(632): n is a, c, g, or t
  misc_feature (640)..(640): n is a, c, g, or t
  misc_feature (650)..(650): n is a, c, g, or t
  misc_feature (664)..(664): n is a, c, g, or t
  misc_feature (673)..(673): n is a, c, g, or t
  misc_feature (680)..(680): n is a, c, g, or t
  misc_feature (684)..(684): n is a, c, g, or t
  misc_feature (689)..(689): n is a, c, g, or t
  misc_feature (695)..(695): n is a, c, g, or t
  misc_feature (698)..(698): n is a, c, g, or t
  misc_feature (704)..(704): n is a, c, g, or t
  misc_feature (724)..(724): n is a, c, g, or t
  misc_feature (727)..(727): n is a, c, g, or t
  misc_feature (739)..(740): n is a, c, g, or t
  misc_feature (752)..(752): n is a, c, g, or t
  misc_feature (755)..(755): n is a, c, g, or t
  misc_feature (766)..(766): n is a, c, g, or t
  misc_feature (768)..(768): n is a, c, g, or t
  misc_feature (771)..(771): n is a, c, g, or t
  misc_feature (774)..(774): n is a, c, g, or t
  misc_feature (784)..(785): n is a, c, g, or t
taagtttttgttttctatttgaaattaaatggaatctgttggagggttatcaaaattgtttgcatcacaaataggtagtttcagtaacaggataggggcactcattaagaaatttcaattcgcacatatttgttttttctttttcttttttttgactaatttggtnatttgccatttctgggnattaaactttaaaaaatgttcttcttttctgtatctgatgttctgtgagcnantagtgatgcagccaacacnaacggttgtcatgtgtaacacaactttcgatcaccgcgaaaacaccgtccngggaaagcgtccangcttgatatcnnttggtncatgaacatnaagttncccgtncaggngacccctacctcacagcgctaaatanttgccnacattatncaatttataanntaatanaccattnatgagattgttncnatttgaggttcngctcacntnnatttttcctagtacagcaggacanaaggaaagacttacgttcttatttantncnttatccagatctgatagatagattcatnnatnatnatcnntnttnaactgcaagggtaattgtanaatcctantgtaaantttgtgtgncgttnctgcnntttnaaangntnggaacttnccctctgcangtaaaatcccaaangaaaccaangccctcncttnatagngctccngcncccgancatgcacaagtctgatgccnggngcacgattgctnncaaataccgacnccnaaaacctttgncnacngtnagtactcttnnctggctta

SEQ ID NO: 117 - DNA, 3834 bp, Homo sapiens
gtgtactcctggctcggctggccggctaaggcagtttctcatcactgatgtgctctgggacagctgagtgggatgggctcctctggggtgggtgtggaggagtggtcgtgatgcctggaacactgcagtcactcctcagagacacgacttggcagccctcctgagcctgcctggtcacatgctgcctgtcttggaaggtcctctgtcccaagcagtggatgtgcagtttcttcacccctgcttagcttcatcaggcacaatgcgtctttgagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttcaaaaaaaaaaaaaaaaaaaaaaaaaaaaaaaaaaa

SEQ ID NO: 118 - DNA, 1450 bp, Homo sapiens
ggcacgaggggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaaataaaaacaaccaaaaaaaaaaaaaaaaaaaa

SEQ ID NO: 119 - DNA, 2767 bp, Homo sapiens
gcggccgcgtcccttcctgcggtccgctgctcgggcggctccagcaccagcgccggctgcgttccgggcctccggtcgcccgtccagcccctcggctaccgccgccgcctcccccgctcggcgccatggccgctgcggccggggacggcacggtgaagccgctgcagagcgccatgaagcttgccaacggggccatcgagctggacaccggcaaccggccccgggaggcatacacggaatacctgaggagcatccactatatctcccaggtgttactagaagaagtggaaaccactaaagaagctggggaaactgtgccccccgacacctccaagatgctgaagctagcacagcagtgtctggagagggcccagtcgacggccgccaagcttgggaaaacacgcctgaagccaaccatgcctgcagctgctcccattccccagcctgccggccgacaccgccgtgtatactccgatgaaggaggaaagctctctccttttctgccacccgagatcttccagaagcttcagggggcagagtcacaaagctgtaagaaagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggccccgtggggtctccctcacccctgggggacaccgcatctggattgccagacaaggacagctcgttcgaggacctggagcagttcctggggacgtctgagcggcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccgggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttactcaccttggctgtgggctgtgaacattccgggaccctgggcatcttatctaggtccgtgcagcccaagggtcagccctcttgactgtcacatgctgcccccacccagcctaaaataaagagctcactgctgtgcaaaaaaaaaaaaaaaaaa

SEQ ID NO: 120 - DNA, 1705 bp, Homo sapiens
gtgctgacgtcggacgccgccgcggcgcgctctgcagactccgggtcgccgctccgccgggacgcgttggccggggcgcgcggtgcttggctgcggtgctcacactcatgaggagccggaagctcacaggtgcagtgcggtcttcagcgcgcttgaaagcacgaagttgttcggcagccaggttggcctctgcccaggaagttgctggttccacgtctgccaagacagcatgtctgacttcctcatcccacaaagccacagacacgcgaacgtccaagaagttcaaatgtgacaaaggacatcttgtgaagtcagaattacagaagcttgtccctaagaatgacagcgcttctttgccaaaagtgacacctgagaccccttgtgaaaatgagtttgctgaaggcagtgccttgcttccaggcagcgaggctggcgtttctgtgcagcagggggctgcaagtcttcctctcggtggctgcagagttgtgagtgactctcgcttagcaaagactagagatggcctgtccgtgccaaaacacagtgccgggtccggagcagaagaatccaacagcagctccactgtgcagaagcagaatgagccagggctacagacagaggatgtgcagaagccaccacttcagatggacaacagcgtctttctagatgacgacagcaatcagccaatgcccgtgagccggttctttggaaacgttgagctcatgcaggacctcccacctgcgtcttcatcttgtccttcaatgagcagacgagagttcagaaaaatgcatttcagagccaaagatgatgatgatgacgacgacgatgatgcagaaatgtaggggccatacaaaataatgtccttgagtatttagtaccattaacaatttgacaatttagcacattacaagatttatataaaatgtatctccaagagaatgtcttaatcaaacttcagaactgacccatctaagtcaatagtgcaaagcacccaatacctgtggaggatgtactcatgggaactaaaactcaaaccatctttgaggttgcaaagctgctgtactgtgccaatgtcctttctttttttttttttttttttttccttggagacagagtttctctcttgtcgcccaggctggagtgcaatggcgcaatctcggctcactgcaacctccacctcctgggttcaagtgattctcctgcctcagcctcctgagtagctgggattacaggcatacaccaccacacccagctagtttttgtattattagtagacacgggggtttctccacgttggccaggctggtctcaaactcctgacctcgtgatacgcccgcctcagcctcccaaagtgctgggattacaggcgcgagccaccatgcccggccagtgtcctttcttatacacgtacatacatgatgatggcttgagtcagctgcagggcagtgggcttaatgagagggatctttgtaaagacagctcttcacttcagctcagtagctttggtcataggcaagtttgttttccattatcataatttgatgattcttgtgatgaattcaatgctagttcttaaagaactcttttatttctgtatgtggagctaatgtttaccttggaaattttgcaaaatacatgtaagaaagaaataaaatatattttgaaaataaaaaaaaaaaaaaaaaaaaaaaaaaaaaaaaaaaaaaaa

SEQ ID NO: 121 - DNA, 2526 bp, Homo sapiens
gcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaacctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctga

SEQ ID NO: 122 - DNA, 786 bp, Homo sapiens
ttcctcaatggttgaactaatttacattcccaccaacagtgtaaaagtgttcctatttcttactggggggttttgagcccacttagtgctcattctgtgctgtctcactgtccctcggagggggagcaatgacacttacaaccacctgctgtgggagcctatgggtggtggcagagcccgaacacctgcttccaggagccttgggcctgacactagtccctgcccctatgtgccctggttctgacctcagaacctggagctgagctggttcttagagagcatcttgttctacttctgatggtgcaggtagagaaacacagcccagagaggtgttgtgaccaaaccagaactcctgacccctgcccagtgtcaacactcagatcccacagtctctctgcacctgctatgtggaagaactcaacaagattgctgtccaagaagtcattggtgaggaagcccaggagatgctgcatgttgttttaggacgtgtgcccctgaacatatgctcccagcaccgtctcgcctgcagatgcacccagtcaaacctgatgggtcccaggacctcacgctgggggcttaacagtttccattccactctttcctgcaggaagctctgtggctcataaaacattaaaatgagcactgctgccatttcatgaaatgcccagcctgtgaagaatgggttaagggatttttgggagctgttgtgtctgaacacaccaggcacatctggggaggcacatctatgaatctccttcctcattagcatggcagctcttcacccta

SEQ ID NO: 123 - DNA, 3656 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggtaaaaaaaaaaaaaaaaaaaaa

SEQ ID NO: 124 - DNA, 6882 bp, Homo sapiens
gggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 125 - DNA, 8708 bp, Homo sapiens
gtaaaggactggggccccgcaactggcctctcctgccctcttaagcgcagcgccattttagcaacgcagaagcccggcgccgggaagcctcagctcgcctgaaggcaggtcccctctgacgcctccgggagcccaggtttcccagagtccttgggacgcagcgacgagttgtgctgctatcttagctgtccttataggctggccattccaggtggtggtatttagataaaaccactcaaactctgcagtttggtcttggggtttggaggaaagcttttatttttcttcctgctccggttcagaaggtctgaagctcatacctaaccaggcataacacagaatctgcaaaacaaaaacccctaaaaaagcagacccagagcagtgtaaacacttctgggtgtgtccctgactggctgcccaaggtctctgtgtcttcggagacaaagccattcgcttagttggtctactttaaaaggccacttgaactcgctttccatggcgatttgccttgtgagcactttcaggagagcctggaagctgaaaaacggtagaaaaatttccgtgcgggccgtggggggctggcggcaactggggggccgcagatcagagtgggccactggcagccaacggcccccggggctcaggcggggagcagctctgtggtgtgggattgaggcgttttccaagagtgggttttcacgtttctaagatttcccaagcagacagcccgtgctgctccgatttctcgaacaaaaaagcaaaacgtgtggctgtcttgggagcaagtcgcaggactgcaagcagttgggggagaaagtccgccattttgccacttctcaaccgtccctgcaaggctggggctcagttgcgtaatggaaagtaaagccctgaactatcacactttaatcttccttcaaaaggtggtaaactatacctactgtccctcaagagaacacaagaagtgctttaagaggtattttaaaagttccgggggttttgtgaggtgtttgatgacccgtttaaaatatgatttccatgtttcttttgtctaaagtttgcagctcaaatctttccacacgctagtaatttaagtatttctgcatgtgtagtttgcattcaagttccataagctgttaagaaaaatctagaaaagtaaaactagaacctatttttaaccgaagaactactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaa

SEQ ID NO: 126 - DNA, 839 bp, Homo sapiens
gatgtttattttccatcaaccatttttccatgctgcttaagagcctatgcaagaacagcttaagaccagtcagtggttgctcctacccattcagtggcctgagcagtgggagctgcagaccagtcttccgtggcaggctgagcgctccagtcttcagtagggaattgctgaataggcacagagggcacctgtacaccttcagaccagtctgcaacctcaggctgagtagcagtgaactcaggagcgggagcagtccattcaccctgaaattcctccttggtcactgccttctcagcagcagcctgctcttctttttcaatctcttcaggatctctgtagaagtacagatcaggcatgacctcccatgggtgttcacgggaaatggtgccacgcatgcgcagaacttcccgagccagcatccaccacatcaaacccactgagtgagctcccttgttgttgcatgggatggcaatgtccacatagcgcagaggagaatctgtgttacacagcgcaatggtaggtaggttaacataagatgcctccgtgagaggctggtggtcagccctggggtcagtaaccacaagaagccgtggctcccggaaggctgcctggatctggttagtgaaggttccaggagtgaagcggccagcaattggagtggctccagtggcagcagcaaacttcagcacagccctctggccagtattcctggaggatataacactgacatcagcagggttttcaatggcaacaattgcacgagctgccagcagaagcttctcccaggtcctcttgagatttatgatatagatgccatcacttttccttttatagatgta

SEQ ID NO: 127 - DNA, 733 bp, Homo sapiens
  misc_feature (5)..(5): n is a, c, g, or t
  misc_feature (20)..(20): n is a, c, g, or t
  misc_feature (25)..(25): n is a, c, g, or t
  misc_feature (29)..(29): n is a, c, g, or t
  misc_feature (33)..(33): n is a, c, g, or t
  misc_feature (37)..(37): n is a, c, g, or t
  misc_feature (39)..(39): n is a, c, g, or t
  misc_feature (43)..(43): n is a, c, g, or t
  misc_feature (45)..(45): n is a, c, g, or t
  misc_feature (55)..(55): n is a, c, g, or t
  misc_feature (77)..(77): n is a, c, g, or t
  misc_feature (88)..(89): n is a, c, g, or t
  misc_feature (101)..(101): n is a, c, g, or t
  misc_feature (106)..(106): n is a, c, g, or t
  misc_feature (113)..(113): n is a, c, g, or t
  misc_feature (132)..(132): n is a, c, g, or t
  misc_feature (156)..(156): n is a, c, g, or t
  misc_feature (161)..(161): n is a, c, g, or t
  misc_feature (163)..(163): n is a, c, g, or t
  misc_feature (165)..(165): n is a, c, g, or t
  misc_feature (167)..(167): n is a, c, g, or t
  misc_feature (170)..(170): n is a, c, g, or t
  misc_feature (172)..(172): n is a, c, g, or t
  misc_feature (176)..(176): n is a, c, g, or t
  misc_feature (178)..(178): n is a, c, g, or t
  misc_feature (207)..(207): n is a, c, g, or t
  misc_feature (210)..(210): n is a, c, g, or t
  misc_feature (220)..(220): n is a, c, g, or t
  misc_feature (226)..(226): n is a, c, g, or t
  misc_feature (242)..(242): n is a, c, g, or t
  misc_feature (250)..(250): n is a, c, g, or t
  misc_feature (269)..(269): n is a, c, g, or t
  misc_feature (278)..(278): n is a, c, g, or t
  misc_feature (280)..(280): n is a, c, g, or t
  misc_feature (286)..(286): n is a, c, g, or t
  misc_feature (290)..(290): n is a, c, g, or t
  misc_feature (299)..(299): n is a, c, g, or t
  misc_feature (302)..(302): n is a, c, g, or t
  misc_feature (305)..(305): n is a, c, g, or t
  misc_feature (316)..(316): n is a, c, g, or t
  misc_feature (319)..(319): n is a, c, g, or t
  misc_feature (321)..(321): n is a, c, g, or t
  misc_feature (323)..(323): n is a, c, g, or t
  misc_feature (330)..(330): n is a, c, g, or t
  misc_feature (332)..(332): n is a, c, g, or t
  misc_feature (334)..(334): n is a, c, g, or t
  misc_feature (337)..(337): n is a, c, g, or t
  misc_feature (339)..(339): n is a, c, g, or t
  misc_feature (342)..(342): n is a, c, g, or t
  misc_feature (346)..(346): n is a, c, g, or t
  misc_feature (349)..(349): n is a, c, g, or t
  misc_feature (360)..(360): n is a, c, g, or t
  misc_feature (363)..(363): n is a, c, g, or t
  misc_feature (385)..(385): n is a, c, g, or t
  misc_feature (389)..(390): n is a, c, g, or t
  misc_feature (393)..(393): n is a, c, g, or t
  misc_feature (400)..(400): n is a, c, g, or t
  misc_feature (404)..(404): n is a, c, g, or t
  misc_feature (420)..(420): n is a, c, g, or t
  misc_feature (425)..(425): n is a, c, g, or t
  misc_feature (434)..(434): n is a, c, g, or t
  misc_feature (443)..(443): n is a, c, g, or t
  misc_feature (447)..(447): n is a, c, g, or t
  misc_feature (451)..(451): n is a, c, g, or t
  misc_feature (466)..(466): n is a, c, g, or t
  misc_feature (468)..(468): n is a, c, g, or t
  misc_feature (471)..(472): n is a, c, g, or t
  misc_feature (476)..(476): n is a, c, g, or t
  misc_feature (482)..(482): n is a, c, g, or t
  misc_feature (484)..(484): n is a, c, g, or t
  misc_feature (495)..(495): n is a, c, g, or t
  misc_feature (499)..(499): n is a, c, g, or t
  misc_feature (505)..(505): n is a, c, g, or t
  misc_feature (510)..(510): n is a, c, g, or t
  misc_feature (513)..(513): n is a, c, g, or t
  misc_feature (529)..(529): n is a, c, g, or t
  misc_feature (536)..(536): n is a, c, g, or t
  misc_feature (538)..(538): n is a, c, g, or t
  misc_feature (540)..(541): n is a, c, g, or t
  misc_feature (544)..(544): n is a, c, g, or t
  misc_feature (549)..(549): n is a, c, g, or t
  misc_feature (553)..(553): n is a, c, g, or t
  misc_feature (573)..(573): n is a, c, g, or t
  misc_feature (586)..(586): n is a, c, g, or t
  misc_feature (591)..(591): n is a, c, g, or t
  misc_feature (594)..(594): n is a, c, g, or t
  misc_feature (600)..(600): n is a, c, g, or t
  misc_feature (636)..(636): n is a, c, g, or t
  misc_feature (643)..(643): n is a, c, g, or t
  misc_feature (645)..(645): n is a, c, g, or t
  misc_feature (653)..(653): n is a, c, g, or t
  misc_feature (671)..(671): n is a, c, g, or t
  misc_feature (678)..(678): n is a, c, g, or t
  misc_feature (690)..(690): n is a, c, g, or t
  misc_feature (706)..(706): n is a, c, g, or t
  misc_feature (713)..(713): n is a, c, g, or t
  misc_feature (715)..(715): n is a, c, g, or t
  misc_feature (727)..(727): n is a, c, g, or t
gggcncacttggtttcttcnccaancccncccncaananggananattctggagnttcactgagggagccccccccnggtttcctaanngggcacttccanattanccttcanacctctctttccaccttanccaggggaggggggcttaccaccncccananananaananggananccaggggggagccgccttaacttcttaanccncaaccactanatttgncaatttccgcaaggancttcacgnctttctggttggcttgggntccattccnanccaagntaancatttgganccnaanattttcagganccngncncctttcncngntanancangaancanctggctttacnggncccatcatctcagcctgggaanatgnncanaaactgnccancttttaaaaagcttcncttgnctttgaggnccccaaaancaanttanttccatttttgggananaannctanactcangnctccacttccnccantcccanccagnccnctcttgggttccatantggtccnangnnccncccanaaantgggcttcaccaaattccanccttggacctccncttcnccnaaaacncaccctccctgaacctggttcctcagctcccaaggntttgaananaaattcangcggaggaaatcccaagnctggatntcccagaacccntatttcatctaggaantgaaaantnacacttgggaancgcaaa

SEQ ID NO: 128 - DNA, 4303 bp, Homo sapiens
agtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgtaa

SEQ ID NO: 129 - DNA, 774 bp, Homo sapiens
cacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtga

---

We claim:

1. An antigen panel for identifying immunoreactivity associated with a premalignant or malignant prostate, the panel comprising antigens encoded by SEQ ID NO:5, SEQ ID NO:10, SEQ ID NO:12, SEQ ID NO:17, SEQ ID NO:18, SEQ ID NO:19, SEQ ID NO:20, SEQ ID NO:24, SEQ ID NO:25, SEQ ID NO:32, SEQ ID NO:34, SEQ ID NO:35, SEQ ID NO:40, SEQ ID NO:44, SEQ ID NO:64, SEQ ID NO:68, SEQ ID NO:72, SEQ ID NO:76, SEQ ID NO:78, SEQ ID NO:80, SEQ ID NO:86, and SEQ ID NO:91, the encoded antigens being immobilized on one of a membrane, a plate, and a filter, and having a positive likelihood ratio of at least 4.

2. The panel of claim 1, wherein the panel further comprises an antigen encoded by a nucleic acid having a sequence selected from the group consisting of SEQ ID Nos: 1-4, 6-9, 11, 13-16, 21-23, 26-31, 33, 36-39, 31-43, 45-63, 65-67, 69-71, 73-75, 77, 79, 81-85, 87-90, and 92-128.

3. The panel of claim 1, the panel consisting of antigens encoded by SEQ ID NO:5, SEQ ID NO:10, SEQ ID NO:12, SEQ ID NO:17, SEQ ID NO:18, SEQ ID NO:19, SEQ ID NO:20, SEQ ID NO:24, SEQ ID NO:25, SEQ ID NO:32, SEQ ID NO:34, SEQ ID NO:35, SEQ ID NO:40, SEQ ID NO:44, SEQ ID NO:64, SEQ ID NO:68, SEQ ID NO:72, SEQ ID NO:76, SEQ ID NO:78, SEQ ID NO:80, SEQ ID NO:86, and SEQ ID NO:91.

4. The panel of claim 1, wherein at least three of the antigens in the panel elicit an immune response in at least about 9% of individuals with prostatitis or prostate cancer.

5. The panel of claim 1, wherein each antigen is expressed by a phage and attached to the membrane, plate or filter via the phage.

6. The panel of claim 1, wherein the plate is a multi-well plate.

* * * * *

UNITED STATES PATENT AND TRADEMARK OFFICE
CERTIFICATE OF CORRECTION

PATENT NO.        : 10,191,056 B2
APPLICATION NO.   : 14/757607
DATED             : January 29, 2019
INVENTOR(S)       : Douglas G. McNeel and Brett B. Maricque Page 1 of 1

It is certified that error appears in the above-identified patent and that said Letters Patent is hereby corrected as shown below:

In the Specification

In Column 3, Line 47, the second CTA5 should be --CTA8--

In Column 6, Line 20, the second CTA5 should be --CTA8--

In Column 6, Line 43, PRO5 should be --PRO8--

In Column 6, Line 43, PROM should be --PRO11--

Signed and Sealed this
Sixth Day of August, 2019

Andrei Iancu
*Director of the United States Patent and Trademark Office*